United States Patent 11,913,074 (METHODS FOR ASSESSING RISK OF DEVELOPING A VIRAL DISEASE USING A GENETIC TEST) - sequence listing, part 9

SEQ ID NO: 259 - DNA, 102874 bp, Homo sapiens
  source 1..102874: mol_type = genomic DNA
agaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgtcaccccccgctcccccgccccccgttccaatcctaagataccggcaataatcttcaatcttgcttaaatcatctttgtttccaacacctagcactgtgcctggcacaggaggctctccataaatgtggttgaatttattgtgaaagaaataagaggagggggtcatttgattgatgttgtttagcgtgtccagaacatagaataaatagaactgattacattcaccctatcattcaacagagataatatactaacgatgaaggttccacaacttgtaatactagaagggatggtccgaaagaaataattcatccatctcttttccttcctctctctctcttatacacacacgcgtacacacacacacacacacgcacgcacacacacacacacaccatagccatttgcatcaaagcaagcagttccattttaaggttcaaaatgtcttctttgaatgtatcttttacacttccttttccaaaatcaggatttctacaaatgacacaggtaacttgatgtctactatttactgttccatacacacatatagtgactatatcagccatggcctggcaagtttgataagtgaagccattccattttttagaacaaaaaaatgataaaataaatatggagatgggattttttgagctgttttccaactactggtttggttagcaaaagtacacatacttgtgatttgtcaagttgaagatactattcttgactaagatgctaccgagtcggtgacagttttgaatcgtgactcttacatttgggggtaactaaacactgttttctcatggtgctttaaaaaatactctttctatgcacgttcagggagcctgctgttgtgtttccaaggtgataaaactctcagagctctcccagggagattccggtaaaccctgagactgatgaacccatgcttggggacttggtcctcaagtttcagggaactcaggtttggggcaagtcccaggaagcaaaggaacggagattgctaaactggtgtaagattagaggtgttattttaatcacaagaagctgttcaactcttgggtttcttttttaaaaattaatttcccatatccagaattgtaattggtagggtaacaggcaactggttttaccagtggagaggaataagaaaaggaagtaataaaaataccttttctggtgcttgtacagaagaagaataaaagagtttcccaaacacacaattagtagttgagtcagggagtctattcctcactaaaaatcatactgaagttataaatttagaaaacatgcccttcccccacaagacaaaatgacttaggaattgaatacaaaggtgagttagtcagtggctggaatgtatggtacagagctcctgaaccagtggattgctaactgttgctctcctctcctcctaggtgcaaggcagttgatacctggctgtgtttaaagagagagcatgccatacatatttcaaaacttgacatcccccatttcaaaatggagagtatcttacttttagagttgctgggataaatatattatttatttaaacatttcaaggttcaaaaaagaaaataatacgcctttggaatacagaaatatgttgaattattatgatctgtaattttttttttggtttttttttgtttgtttttttttgagatggagtctcgctctgtcacccaggctggagtgtagtggcttgatcttggctcactgcaagctctgcctcccgggttcatgccattctcctgcctcagcctcccgagtagctgggactacaggcgccaccacgccccactgatttttttgtattttaagtagagttggggtttcaatgtgttaacaggatggtcttgatctcctgacctcgtgatccccctgcctcggcctcccaaagtgctgggattacaggcgtgagccaccgcgccggccaatgatctgtaaatttttactcctaaatttttaggagctcaaaccttgcaatgaatcagaaatatctaggggtgcttgataatatgctgatttctgggcatcatcctcagagactctgaatctatagacctggggtaggccccagaaagtggcattccaacaagcatcccaggagattcagacgcaggtagcgggtggattatagcagcgggtggattacattttgaataactgtaacacatagtttctgtgatgggacaagctgtgtgaagtatcaggagcttatttctccattgcaagtttagatctggggtagaatctcagcgagagggcacaaagcttactctgtccttctggtctcgcttttaaactttattccttattttgtataacttcgtttaggcccagagaatgccaatgactaactgctcttaatacattaaattaaagctcattcaaaagcaggttaattaaaagaaattatctagccaactttttggtataaagcaaaatacagagttatactttctgctcaagtagcatgtagcttttaagaatatagactctaatgattgccattctaactggtgtgagctgatatctcattgtggttttgatttgcatttctctgatggccagtgatgatgagcattttttcatgtgtcttttggctacataaatgtcttcttttgagaagtgtctgttcatatcctttgcccactttttgatggggttgtttgtttttttcttgtaaatttgtttgagttcattgtggattcttgatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccatggcttttggtgttttagacatgaagtccttgcccatgcctatgtcctgaatggtaatgcctaggttttcttctagggtttttatggttttaggtctaacgtttaagtctttaatccatcttgaattaatttttgcataaggtgtaaggaagggatccagtttcagctttctacatatggctagccagttttcctagcaccatttattaaatagggaatcctttccccattgcttgtttttctcaggtttgtcaaagatcagatagttgtagataggcggcattatttctgagggctctgttctgttccattgatgtatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggagaaataggaatacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaactgtcgcaaggacaaaaaaccaaacactgcatgttctcactcatagatggaaattgaacaatgagaacacatggacacaggaaggggaacatcatactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataaaaaaaaaatatagactctaacatgtttaattcatttgcaaatatttaatcttgaggtaatgcatgctcaaatattactaagttgcctgattcttcccacatacatcagggtcaggttgacagtaaagatgcataaacatgccttgggccttttaatgcacacttacccagaaacaagagtgaggaagagattcattttgaggttgtgtcctggggtggcaggagcaagtccaatggaggaatagagacttgggttcaggtcagagtctctaccacttacctgtgctgagaccacaggtgagacctaacctgcctgagcctccgtttcctcatttgtagagtcagatttccttttgctatttattaaatgagataatgtatgaaaatgcctggcacttagtggatacttaacatgtaccatgttcattctattccctttgcctcctagcaaatccttaacctcttgctcactgtgatattttgcatgttttcacatggtgacatgccaagtggtagagaaggaagccacggcctgtgatgaactgtatggggtggtcacagaaccttagctttttattctcactgcttatgtcattgatcccctgggacccaaagatgcaccctggaagaaagatcaagaagcatttggtgctagattcactagcaagctatctttagtatctcttttagacttgacaatgtcattatttccactaacagatgaggaagttgagacttgagaagtcatgcattcagatacggtggtggtgtagctggattttgaattagtatggggcaaaggccatgttctctttactgtcgctgactgcttctctagggcacagtcctggacctcaaagaatctgcactttggcacgggagctaagacttgtagctgtaataaaagtgactcattcctgagccaaacactggggttttcaccggagataaattgatgaacaaagtatgcaaatactgccctgccctcttgaaactgatgatctagtaataaattaacagaatctgccatgacctatcagaacttgaactagttaggggaaggctttccctagcgtgaagtgacatcaaacttgcgatgtgaacaatgagaagttaagtaggtatattagtcaattttcacattggtgacaaaaacaacctgagactgggaagaaaaagaggtttaattggacttacagttccacatgactggggagcctcagaatcatggcaggaggtgaaagacacttcttacatggcggcagcaagagagaatgaggaagatgaaaaagcggaaactcctgataaacccatcagatctcgtgagacttattcactaccatgagaacagtatgggggaaactgcccccatgattcaagttatcgcccactgggttcctcccacaacatgtgggaattaggggagtacaattcaagatgagatttggatggaggcacatccaaaccataccaataggtaaggtggacagcattggaagtaaagaagagccttctaggttgagagaactgcctgtgactgcctgtgcaaaggtcctggggtaggaaggaatgaaacagtcaaggtagtcagagtccaaaggttgaggagaaggctaacacaggataaggcaggacaggtaggcagggctatgttatggagggcatcggggatggtgggattgtgtcatgattatattttgtggttataaaggtctaacttcaggataaatgcattgaagagaagttgagtgcaggcaaggaggtcagataggagcctgttgcagtatttaggtaaaatggaatgtggtttagatgagagaggcagtgtagttatcaactgagatatgaactcctaagagtacctctatcacttattacctatgtgaatttgatcaagttccttaccatttgtatctccaaatttctttatgcataaaataattactatggtctacctaatagggttgttgaaaggataaaatggattagtaagtgtaaaatatatagaataatgcctggcatgtagtacatgtccattagacttcagcggttattgtcagtaatgcagatggagaggtggatagaatcagtagctatttagatcaagttgactggatttgatgatagcttacatatgtaaggttggaaggtaagtgcatcaagagtgatcgcaaaatgtatgtaaatgtgtgtaaatagtacagtggggcacaagttgaccagtgataggaaaagcttcttgaaggaagtagtagctgaattggaccttttaggactggaacatgcaaaagaggattatatagccctggtgaaaagagtgacccaatgttcttcagttctgaagactgctgggaggaggaagagttctttctcacctgaggctactttaccagaagttctctcagtctaaatcacaaatcctagtgattgtgtatcatcctttcctccacttcctgccaagctcagcaactcaaaatatgctgttggtcctgagaaaggaaactgggctaatcccttccttctgaggctgctgaataggagcttggctttcatcagaaagatgctttcactcccaattattacaagatcatcttgcaaattcccattttctagaaggctgattgcttgttcagaatgctcatggcaaacactgttggttacccactcagcagtcatgacctctttttccttattaacacctgaatttgatcagtccatggtagactcagcctgtggatacatcatggtgtaagccagtcatggtaatcctatctccatttatcagatacttattcttccagcttcctggtagctgagggtgactagtgataatattctgacatacaggaagtttgctcagaagcttctaggatgtgggaagagaagccctgccttttttggatactctcatatgaagaaaagatacttggaactgctgctgccaccatgtgagactgtgaggaaaaggttaaggggatttcagagacaccatcccattttctaacatcactgagcagttgaactacccctacctggaactgtctactatcagacttctagacttccttttttttttttttttttttttttttgagatggagtttcactcttgttgcctaggctggggtgcagtggcgcgatcttagctcactgcaacatccgcctcctgggttcaagcgattctcctgcctcagcctcccgaggaggtgggattacgggcactcaccaccatggccagctaattttttgtatttttagtagagatggggtttcgccatgttgggcaggctggtcttgaactcctgacctcaggtgatccacccaccttggcctcccaaagtgttgggattacaggcgtgagccacggtagccagcccagacttcttttgtgagatatgaaatgtctttattgtctaaatctctgttagttgggtactgttcattgcagcccaatgcaccctcattactacactgcttttcaatgaacaatattttacactttacaagaataactaccttctccttcttctccttactggcctttccaggcacccatatcaatagtcaagcccagccaattttcctctgggatttctgtgtgcatattcacttccattgcccccatctaccctttagtgtctctgagctaaaatataacaggagacccttaactgttttctctcattctagtatttcccccacattactgaaaactcttttcttggaccatgggtagtatcatgtatctactcttctataaccatctatggctcactattgcctctaagtttcaaatgtcctggaagatgttctaggcatgacattatttggccccaacctgttctctaattctttctgttgcttcatttatctgtctggcaagtgggaataggattaccatgactgatttacaccatattgtatccatgagccaagggatgtctatccatgcaaatttctccctgttttccagcacatcatgtccttttatgcctccacattgttggcaccaatttctttgcctggaatagtcctcctttttatatccccatttccattttacttctatcaaaatgaaatcttgctcttcctttaaggcccagctctgatcttctctttttcacaaaggctttcacaaaggctttattcccaagttgaaataaattgccccttcctctgttcttccataaaatttttcatatatttcaaatcagtattttacaggtagttaagaacatggtttctagagtcagattatgtgaattcaaatcaaaactctgctacttactaggacaaattttctgacatagctgaacctcagcatcctcatttaaaaatgtggattaaggctgggtacagtggcccgcacctgtaatcctagcactttgggaggccgaggtgggctcatcacgaggtcaggagatcgagaccatcctggctaacatggtgaaactccatctctactaaaaatacaaaaaattagctgggtgtggtggcaggcgcctatagtcccagctactcgggaggctgaggcaggagaatcccttgaacccgggaggcagagcttgcagtgagctgagatcatgccactgcactccagcctgggcaacaagagcgaaactccgtctccaaaaaaaaaaaaaatgtggattaatagcaccttgatagagttgtgaggcaagtgagatagtgtgttgttattatttttctttctctgaagtagttattccaatttgcctttgattatacttagctttatagaatgttctcactcactgaaatgatttaaagtttttggaaaaagagagatgaactggagaaaaggtaacacttactaagtcatactgtatttcagacagtctgccaaatcccttacaaatcaacaaccttgagacaaggtaaggacaccatcatcatcatcatcatcatcatcatcatcatctctactttacaaatgaggaaacggaggctcggagagttacttggctgcagtcacagcaaataagtggcaaaggcaagactcagagccatgcctgtctgatgtccaaggtccgtgctctccaggagtctctgctgtcttctgtcatggagagggccaaaactctattgtcctaaggccccttcaacatttcatgttgttttagcacaaagtaggtggtcagtaaagtgtgttgaatgtgatgtgtaatacaaaaacgaggcaggcagatcacaagctcaggagttcaagaccagcctggccaacatggtgaaaccccgtctctactaaaaatacaaaaattagccaggcatgatggcaggtgcctgtaatcccagctactcaggaggctgagggggaagaactgcttgaaaccaggaggtggaggttgcagtgagccgaaattgtgccactgcactccagcctgggtgacagagtgagactccgtctcaaaaaaagaaaaagagaaaaaaaaatgagtgatagaacaaacctttctcagcaaaccccaccttaaaacccaactgtgtcaatatgagtttatttacagcccattgattcatgaattaaaaaaaaattgaaggccaaagcaatcacaaggtaattataatttaaagtgagttattctaaacttacatataatgatataagaattttaaaattccaagattctccagaagcttaaatggaaaaataaagtgcatcataatcatacattccccaccctcacacatgcacacccttatacactcatcaacaaaacacagttctggaagaagatattaaaataaaaacttaaataattacttttgtagattgggaatggagatttggagctatggaggataatttttatttttgtattgctagtttttaaaatttttgtcttgcttttataatttaaaaccaatttattttattttaaaatttgtattctttttcttaattgcagtaaaaaatgcataacttaaaattcaccattttaaagtatatgattcagtggcatttattgtattcagaatattgtacaactaccaccacactgaccatgatctagttcaagaatatattcatcagccgggcgcggtggctcatgcctataatcccagcactttcggaggccgaggcgggcggatcatgaggtcaggagatcgagaccatcctggccaacacggtaaaaccccgtctctactaaaaacaagaaaatatgaaaaaaaattagctgggcatggtggcgggcgcctgtagtcctagctactcggaagctgaggcaggagaatggccgaaacccgggaggcggagcttgcagtgagccgagatagcgctactgcactccagcctgggcaacagaacgagactctgtctcaaacaaaataaaacaaaacaaatatatatatatattcatcaccccaaagggaaactcattgcccattaagcagtcactccttatttcctctcttcacctctgcaacaatcactaatctgctttctctatccacttgcctattctggatatttcggatagatggacacatataatacataaccttttgtgtctggctttttagacttagcataatgtttttaaagctcatccatgttgtggcatgtgtcacaattcattcctttttatggctgaataatagtccattgtgtagatataccacattttgtttatcctttcatcagttgatggacatttgagttgtttctgccctttggctatttgtcagcagtgctgctataaatatttcatgcacatgtttaaaaaagcagctggttaaaaaaaatctttgtatggtttcccattgcctaaccgtgtgataaacccaggcctggccttgctgactgtttgcccaaccttccacgttgttaaattcctttgtgtctttgtccatgctcctttttcaccttccattcgctggatggatacacatttcaagactaaatttaggtgttacctcctcaatgaggtcattgctgacatagcttcctgccttccttccacaggcagagtgcagtggtacaatcttggctcactgcaatctccgcttcccaagttcaagcaattctccacccgccacctctcaagtagctgggactacaggtgtttgccactaattttttttttttttttgtatttttagtagagacaggatttcaccatgttggccaggccagtctcaaactcctgacctcaggtgatctgcccacctcggcctcccaaagtgctgggattataggcgtgagccaccgccccggcctgtgtcctactttctactcagtgcctccttacaactcttacttgatctcatgagtctccccaaaacctgagcttgaaggcaggttcacaactttatcacctttgtgttgacagcacttaacacatggtgggcactctgatgaatatttcttcaataactggtgcttggatttttttcaccacaggataaccaggttatcttccaaataaccagttgtttgaataagaactctggttttttctaatctagatgccaatgtatgtggttactgggagctgtaattagttttatgtcctggtgagtaattaagaaccctagaagagtacattttaattagaattctgagacctcatgaagttctcaaaggcctttaactctgactatgttaaggacttgcaataatgtagattataaaggcctgcttgcttcttttggttttgtattatggtttattaagtgtttgctttttcataagatggtaatttacttgaaatgttgcttgtaaatgccacttacaatttacagtcctggaacatggtagaccctccataagcaatagctcttgttatccatcgcctatccatcatagtactttacacagagcttttgcacaaaattagcattcaatgcatgcttttaaatgaaagaatgaatagaatgggtatatgctcttcacagagtagacaagaaatagttaatcaacattctcagatggttgtagccaatgtgcttgaagatgcaacacaagaagtaacatcgttggtgacttccacacactgatgcagagtttttctcctgagctatttaacctataaattgtttcctttcagcctgtgtagagtggtctcaggtaccctttaaccctttttggaaatgcaaaacacagaagccattcctggttcctagatgagtggggacacttgtgcctcctcaccttcctgcagagcgtggactcaatggtctgtggtgctactatgcttggagctcatgagagctgacaatagctgatggagagcaaggatctcaaggtcttagggataaaatggtaagcaaaagagatgcggttcctgccttatttgcactcggagtcaataatcaaattagtatggatcagtatacagtttctaaaaggaaaaaatgcagagtgctctggagatgcaaatcagaggacttggcttattttgaggagatgcttcaagaatgtaaccccaaagaagtcatgttggagctgagtctgaaggttaaatgggaattaactaggcagagagagggaggggaaaggcctatgcaaagacccagaggggaggaggaaccaggaaccaggtggcaaagaatggaggaggaggaggtggtggaactagatgagggcagagagaaacatagtcattcccgttagcccaagagccatggaaagcctacgaagggtgtcagaggaagataggtcagatttacaatttttttttttttttgagacagaatcttgctctgttgcccaggctggagtgcggtggcgtggtctcggcttactgcaagctccgcctcccgggttcacgccattctcctgcctcagcctccccagtagctgggactacaggcgcccgccaccacaaccagctaattttttgtatttttagtagagacagggtttcaccgtgctagccaggatggtctcgatctcctgacctcgtgatccgcccgcctcggcctcccaaagtgctgggattacaggcgtgagccaatgcgccctgacataggtcagatttacttctaaagaatatattaaaaataatttcagagtaaggagcagaatggagcagagcaagacttgctggaagagatgagttagaaaatgactgcagtggaccacaaaagagacaggtagatggtgatagacatggagagaaacagggagctctgtgagatgagaaggaggtaaatcaatgggatttgatgacaaaaatgggtacagaggaaagggaagagctttcctgggttttaggcttgtacaactggatggatatggtggctgtcactgagtttttgaagtcaaataaaacatagagacaaatctctgaaatgaaaacattttatttgggaagaaaaattgcaatttggggggcatgcacacagaccgactggccttcagtatgtcccatgaacaaagagaaagaagttttataaaaaagagaaatgttacatattgctctttgagaaagttcattggcattagtaaggtttgagggagctggcaagttttgattggtaagtgacagtaacaggtaaaattattcttttttttttttttggactgagtcttgctctgttgctcaggctggagtgcagtggcacgatctcggctcactgcaagctccacctcccgggttcacgccattctcctgcctcagcctccccagtagctgggactacaggtgcccgccaccatgcctggctaattttttgtatttttggtagagatggggtttcaccgtattagccaggatggtctccatctcctgaccttgtgatccacctgtgtgggcctcccaaagtgctgggattacaggcgtgagccaccatgcccggccaactattcttaaagtcacaggagattgtttcagcagctgttagataaaactgtttcaggtgcaggaggcagtttcaggtgcaggaggcagtttcagcagccaggcttgcatagaattacgttcttggagcaatgttttgttccctgagtgcttttactcctgacctctctgttttagttgggtatgacaagaatgacacatttgttgattaactttcacatagggaagagaagaagaggtccagccagggagggtggatccagaggtctgctttggtcatgctgagttgagatgcttttgtgacatctacatggagatttgaagcagatgttgacttgctggtctggagctcagaggagatatctgaacgggcgatataaaatgtagagtaaaggttgagaagacaacaggaactagactaattcctcttgttgagtttagagttaaagagaatgagtaggatgaggacaatccaaatatcagaggaagacaacgggagggtattgtcatagaaggcaagagatggggatacttcaagatggagggagcagtgcaggtgtcatgttactgagacataagaacaacactggaaaaatgtccagtggatttagaaacctcaggcaactgttgaccctaggaagcttatttcagcacagggagagggtggcaatcagcttgggttaggttttggaatgattggaagataaggacatgcagacagtaatcacagacaactcttttgagattaaaaaaatgtgtagtgttttatcatatgagaaaaataattgcttccaacagcaataaaatgtaaataagttacatacctgttattcccactgcttaagttatcagaggacttttatacaaacatttgcatttgtagcattctgaggaaaaaatgctctggctgggccgggcacagtggctcacgcctgtaatcccagcactttgggaggctgagtcaggcagatcatgaggtcaggagatcgagaccatcctggctaacatggtgaaaccctgtctctactaaaaatacaaaaaaaaaaaaattagctgggcgtggtggcgggcgcctgtagtcccagctactttggaggctgaggcaggagaatggcgtgaaaccgggaggcggagcttgcagtgagccaagatccagccactgcactccagcctgggctacagagcaagactccatctcaaaaaaaaaaaaaaaatgctctggctgtcctctggtcttcaaatactttgcttaggtttctgtgaatctttaaatttcaggtgacttaagtgcacattcaatctactgaatcacaattcacttgtgctcatattcctgtatttgtatgatttttcccagccttcctgtattgtatggtgaataacttctttccaaggacgtttcaaaagttaagaaagcatgctgctgttgcccatttacaaatatttaatttcaaaggatgccaaagcattggcaaatatatgtgtcagagcttagagttagttgcagccttcttaataatcattttactattttatttcagaaatataatctagcatttcagcgtcactggaaatcttggtaggtagtcagtatttttgtttggaagtacaggataccagcagtgaaacacttcattttattaacgtcaagcaagtaaggcattattttcctataaatgtgaggttgtttgaaatgaaaacaaacaaaaccaggtaagacgatagaagcagatgttttctctgtttaaaaatgcggttggtatgtgaggtatgtgtagggaatggctaaaaagaaaataaaaataaaatttaaaatgcaatttgggttgggcatggtgtctgatgcctgtaatcccagcactgtgggaggccgaggtgggcggatcatcggagatcaggagttcaagaccagcctggccaacatggtgaaaccccgtctctactaaaaatacaaaaattagccgggcatgatggcaggtgcctgtaatcccagctacttgggaggctgaggggggagaactgctcgaatccgggaggtggaggttgcagtgagctgagatcatgccattgcactccagcctgggtgacagagcaagactctgtctcaaaaaaaaaaaaaacaacaaaaaatgcggcttgttcctagttaagcattttaagatttcccccttccccaagggaagagagaaaatcttacccctccttctgttcttcccttctgggtgaatgactgtacaatgaagatttaatctagttgagaaaaacaacacataggtgactcacatacaacctttgtatgtatgaatggaggcttgtataatcatttgtttttcactgtcctgacaatcaagtgggaatgagaaaaataagatttatgctagatttatttcagttgcaattagaaggaaaactatccctgtgatctagacaggattggatgtttcaaaagtgccaaatcattgagcagatagagaaagtgagaagacaataagggaacaagatttggaaaggaaatgatttaacagttacgccagtgtcctcactcatatgcaggagttgaaaaagttgatcttatggagatagaaagcagaatgatagataccagagactgggaaggatgtgtgggtggggtgggggtgggggaatgaagagaggttagtcagtgggtagaagggcagctagatagaagttatcaacaacgtattctacatttcaaagtagctagaagacagaacttgaaatgttcccaacacatagaaataataaatactcaagatgagggatcaaataccctgacttgatcattacatattctatgcatgtaacaaatatcacatgtaccctataaatatgtaatatattatttataagtaaagaaacttaaaaatgtaattgtgccaatataaacttatgtatcaatttatatttgttcatgtcttttgacttctccacctttttgttcacactcttaatgcccttactctcttttctcgcctatatttaccatactcatcatttcctctagaaacaccttggttattctgtcctcaccaatttcctttttctcagagttttcatagatcagtccataatgccaatttggtgcttagaaacatatcattgtgcattgttctcgatttttcataggcagtaaattttattttctctaccagaaactaaattcttgacaggcaaagatgattttgaaactgacccaatagttccatagacaggtttttgttgttgttgttgttctgtttgtttgtttgtttttggataaacatagaaattgacgcttttggtcttaaagcctgaaacttacatttgttttatttgagttccttgtttaggaaatgacccccaggcctctcaaaagtatcaaagaactgaaactaaccagatattgcatccagacaatgaaatgccaggcctctcattcatcatgattgcttccttaacccctctggagttcctgttttctcatacctttcttccctgctatataaacccctcattttagtccatcagggagatagatttgagactgatctcccatctccttagctgcagcacctgattaaagccttcttccttgccaataatcgttgtctcagtggtgtttcggtaacaacttcttatatatttacctgaacccttagcagtttgatgagcatacatttaagaaataaaggattccttgaattgttatcagttgaaatgctgcatttctgaacatggcaaaaagtggtctaagaagcatagcttaagcaactttctgtccaccactggtttttctgcgcccagcctctgcctgcaatgtgtgattggcatacagcctctcacaggccctcagaatgtacaggtctaactttcacaaatgaacctggaagataatttgtaattttgtggaggtgtgtgttcaagagcagcacattggtgtgctaatcagtatcccttcaccagccagtgagccttgctgctcatcagcatcaatacctcagtgtaatgtcttgcccttatcatacatgcagaaactctcaagaagtagttgaaaaacaatcaaagcttagcattttagtaaaatgttacagtggttttgagaaaattgctgaccaaaggaagatgtgcacctatcaaagtagtaaatttttactagtgttgctgctgccataggctataagctccctgagagcagggattaggtcttactcacatcattccctagtgctggggtacatcacctgggagatagaatgtgctcagcatatatttgaggaatggctaaataaggaaatgattatttctaataaaaggaaaagattgggcagggtgaggtagcttgtgtctgtaatcccagcagattgggaggccaaagcaggaggatcacttgagcccaggagtttgagaccagcctgggcaacacagggagatccctctgtacaaaacaaacaaaaaaacacgagctgggcatagtggtgcgtgcctgtggtcccagctacgcaggaggcttaggtagagtacagcttgagcccaggaagctgcagtgaattgtgattgcaccactgcactccaaactgggcaacacactgagactttgtcttttttttttttttttttttttgagatagagtctcgctctcttgctgaggctggagtgcagtgatacgatctcagctcactgcaacctcttccttccaggttcaaatgattcttgtgtctcaaccacccaagtagctgggattacaggcatgcaccaccatgcccagctaatttttgtatttttagtagagttggttttgccatgttggccaggctggtctcagtctcctggctttaagtgatctgcccaccttggcctcccaaagtgctgataccctgtcttcaaacaaacaaatgaagaatgtatagcacttactatgtgccaggcactgctctaaatcttttacatatattaactcatttaatcattgcaacaaccctataaattaactattctttatctctatttttcagatgaggaaactgtgtcaccaacagtttgagtgccttgttgaaggtcacatagctggttactggtagagttatgatttataatccacatggtctgactttacatttaacagctctcatatggaataaattaaatgctatactgctattcagatatgtgggaagacatgaaagcctcaagatatagtcaccagcctctgttacaagcttgttgtttgtttttgcttttggctttttgtcttgccacggcaaactcctaagggattctggtaatttgttagcaaactttctaaacccttccaagactgccaaattgctaattcttaagcagttttcattgacactattacattgtttcatgtcagggctttagaagcaggtgaaatagatattggttttgggaagtgggggaaagctgactagtaattgatgaatggctagcatctttatacaggagaggaatttgcaaggcaagtaggtgggcttgttctgagtttcttttgttagtttcaggagttaggcttgttgaattaagtaaataaagctcacaatgtgctgatcatgtgaaacctaatgccaagtctatttctgagccactgtgaagaggacatagataaacaaggagggaggagtgtcaagtcacacaaaatatttcttactggacttggattttattttttaaatctattcttttggaaatagagccatgatctaacttaatgtggctactctgaatgcatgctttctccatgtccactctaatttctttgcaggttcgtataaattttgtaagtaggctttgtaaatcaaactgtggactaaatatcctggtgcgactctcaaattgctctctcaaattgcaggcacaaagtcttggaagttctgttgggcagaaacaaactggaccaacattttgcgtttctgttatcatccaacttcctatatgcagtcaatctgataacaaacaagctaatgagctcacactagaattagaaattataaaacatttggttttccaggggaactgggaatggttttgtaattaatgtgtcagaaggaaaactgaagcaaagaagttttcaattgcaccatatatgacagacaaaaaatgaaattaaatgcatccttcagctctgaggacagataatggtcctctgtatctaagcgtccaggaggaggtgttctctctattccatacatctgtgtcccagtgaccaaatgcaatgaagagagacaacttgtaaattaaacaaacacaatggggcataaagatttttcccctttaatattacgggatatgacaaagaagatcattttctggttgccgtaaaaatacaacagtaaagttgaattagacccgcagatttgattaatgaatgctgtgcttatgaaaacacataattattcctgagctcttggaatgaaccaagtgcggtagcttctggggcacttgtgcatattacttttaaagatagaatcctgcttggcaaaaatggctctcccagttctatataaaagatacagcaagaagcagtgaatgtatatatagacaaagagaaaaataaagctcatagctgtcttcataccagtatagatctttcttagcacataactagatttttgtggattttacaagttaaataatgtgaaaaatatatttgggcacaagccgggatcgctgagctatataaaagggattctatcactcagagagttgtgtgatcatgggctagtcagtatcctttgtcagtgggcctgtctccctcattcgtaaaatggatatggggaggcttactatttccttaccagccatttcaaatatatgtctcctgataacctttgcattttagagctcttcttttgttttcccatgagcaaatcagcaagagctacaagttagcaaacttttaaggagtgcttgctgtgtaccggcccatgataggtgataggggccacaaagatgaaggcgccttttctctctacccatgagatccagtgaggccaatgaattactattattgttgttgttgttgagataggccctcgctctgtcaccttggctgtagtgcagtggcgcgatcatagttcactgcagcctcaatcccctggggcacaagtgatcctcccacctcagcctcccaagtacctgggactacaggcgtgcaccaccatgcctagctaatttttgtatattttttagtgactgggttttgccacattgcccaggctggtctcaaacacctgagctctggcagtcctcccgcttcagcctcccaaagtgctgggattacaggcgtgagccaccatccaccgtgctctgggtcatttttttcagctctcttatagttcatatatactttctccggctattgtatattccatctgttaatcttgtcaaatctattgtatattccatctgttgaccttgctatagcaacaactataattttaattccttaagttccacttagttctttttcaaatttgcctgatcatttttgattgtctcttgttgcttattccattttatgattccattctttatttctttaagcataccatgtatatttgtgtatacttcgtatcagatcatctagactccttgagattctaaatctggactttgtagcttctgctagcctttacctgggatggtttgttccttttgattttggtgacctattttttatgggttcaattttggttaatcttaacctgggaaaatttggaggctgaaattaaagatgtgatcctccagaaaacattttttttttcctgttcagagatagtgaccattggggccaccatgcattttgtgtgggtttattgttcacggctcccatttcagcttagaatctctttttttcttcctcttttttcccctttaaccttcatattctcccttaggtcctgcaaagtgctacctaaaaggtcttgtacattataatgttattttataacttaaaggcccctcagggtatcttgcccaccatatttctaaaagtgaaattgctgatgttattgaatgcttaccctgtgccaagcattcttttgagcattttacttgtgttagctcatttaacactcacaacaacttcatgaggaaaagtaacattttttattctcatttcacaggtgaagaaattgaggtgcaatgcgattaagtaacaggttgccaatgttacacagctgatacatgctacatgagttgataatgttacacggcaaatagagctgggattgtaagaaacacctaaaaaatttatgcacatgataggaaattcaaagtgtacaaaaggctatatagtgaatagtaagtccttttctgttcctgtgccctagacatgccattgcccctcccaggaggcaattattaccagtttcttacgtatttttctaggggttgtgtacaaaacatacaatctaatatatatatatatataatagtatatcatatttattatacattatgtgtctgattttgctagaaaaatagaaataacaaaaagtaacatttcttgaatacttactctatgcttgttacttttcattcattatctcatttgttcttctgaggaattattagttttactttgtaagtgagaaattgagtattacaaaagttaagtaacttgcccaagaatttgcagatagtaagaagcagagctaggattcaaacctaggtcttcgtggttcttgggcctgcacactttggcttttcacagggagctgactaggggttgacatctttaactcctctgtagtggattaggacaagagttagagtaaaggctggggtttagggtttgcgctaggacctcctctctaacccctacaccatacctggatgtggcctgtgcaagtgtgttttaggattgctgcttcctggggaatgagatggagaacacaaaactcaaccttgcccatcttctctgcatctatatttgttagtttcatatgtttaaggataggcttttgttaaccaattactctattttgaaactccctcttctcttttcttctttttctaatttcttccttccttccaaccctcctgtaaacatttatttgagtgcctttatatgtctagcattctgtttggtgctggaaataccaagatacaagaacataactgtcttttgagaaggttgtactttagtggggagacaaataccctaactgcaaattataacacagtgagttaagtgtttgtactttcctatggctgccataacaaattattacaaacttggtggcttaagcaacacacgcagattctctcacatttctagaaatcagaaatttgaaatctgtttcactggtccaaaatcaaggtgtcaacagggctacagtctcctggaagctctagaggggaatctctagattctcctttgcttttccagtttctagagccacattccttttatgctgagttccaggaacttccctccatctccaaagccatgaatgcagcatcttgcgtaagtgatcacattgccttcttctggtgaaatactgctctgacttccccttcttttttttttttttttagatggagtctcgctgttgcccagcctggggtgcaatggtgcgatctcagctcactgcagcctctgcctcctgggttcaagtgattctccagcttcagcctcctgagtagctgggaatacaggcgtgtgccaccacgcccggctaatttttatatttttcggaggggcaggatttcaccatgttggctaggctggtctcaaactcctgacctcaagtgatccaaccgcctcagcctcccaaagtgctaggattacagacgtgagccaccaagcctagccctgacttccccttctaaggacacttgtgattgtatttagggtccaccctgctaatctgagataatcttcccatagccagatccataatttagctatgtctgcaaagtctcttttgccatataaggtaacattcacagatccctgacttttatagttctgttcttttgtcctcattttctcattctgtgagtgtgtgtgtgtgtatcctcaacagtttcctccagacctggtgtactagcaagttgtgtgggttcttcctcaaaataccacccatggggtatttctttttcttctctctctctgctcctctctacactggttgatgcccttattcagataaacattcaaatggtcagctaagggttctccctgtctctaagctctcctcccaacttaccttacaaccattgttccattaattgttctatgtgacccttgtttaaaaacttctagagaataaattctgaactccttagcatgacacttcaaggttctctggagttcaagacctatatcaacttcatttatttattcagcaggtgctcattaggatttctcatgtgttaagactgtgccaggcactgagagtatgatagtgggtaaaagtaggcatgtccacccttggggattttgctgtctaataggaaagacagatatgaataaaataataattatgaagaaatgtgaaattgcaactacaataaaacagcagctcagacttatgtaatgcctgccatccatctagcatcatcctaagaattttacatatactgtctcttgtaatcttcacagcttgttcataactgctacttcctactttatggatgagataacaggtgcagaaagtttaagtgattcaaattcacacagctggaaaggatttaagccaggtagcttggttctggattttgtgtatggaaccactgtcatattttgataaaagagaagtgcctggtgctatgaggatcgttaattgggagtgggaccagggtagaaagaagcacagagagaagcaaaactgcttcatgaatgatgtgttgaggaggtacacagcttgatggtaggccgggtctgttgggaactgttgaggttatatattgggaactgttgaggttatatatatatatatatagagagagagagagagagacagacagacagacagagacagagagacagagacagagtggggatggggaattggaaaagcttcctaaggaagggacagctaaactgaagttggaaatataccttggcattaattggacaggaagaaaggaaaagtgttccatccagagggaagatcatgtgtcaaggccgtatggaggcaaggagcagagtgcttagggggtctgaaatgggaccaggtggagccgagagagcaaaggcagagggaggagcaaggtataggatggctgcagtgggattaggctggggaggcaggtaggtgccaaatcacccaggaccctataggacatattataaaccattttctttatcctaaatgcaatgggaaaccattgccattgagtttttgttttgtttcatttttctgagatagggtctcactctgtcacccaggctggagtgcagtggtatgatcatagctcactgcagccttgaactcctgagctcaagcgatcttcctgcatcagccttccaaagtgctgggatcacaggggtgaaccaccacacccagccccattgaggttctattcagggggtacgacagagatgtgtcagaggtttctggattgtgccctgaattgatgtggtctcattctctggaacggaacccaggaaagagaacatgttcaggaataagatcatggactctgttttggacctgttgactttgagaaacacaaatgagatgtgaaggaaattttcaaatatttggatccagagttcatagaagatgtctgggctgggcctttaagtccagcccttgtgtcactgacttttggcaattgaaagatgaaccttttgaaggacttctatggtgctaaggagaattttaaattctacttgtgagactgcattaatcttttgttgtagatttgaatgtggggtgaaaatcagtcagagtgggaagaattaattttagagtccttccccactttctacttttacaacagaatacctttggataatcatttatccttcaataataggaactagtttttggaaattgtggtttgagtctgctataaggaaaccggcaagacaaaaaacaaataaccaaaaagctgtgtgagaaggcttcttaagactgcaatgtaacctcagtgttcaaggcaaaagggagtgtatttgttagctattgctgtataacaaattaccccaaaacttaggggcttgaaacaacaataaaaatgtattgtcctcacagtttctgtgcatccaggaatctgtgagcagtttagctgagtggcttgagctcaggaggtaagaggtcccaggcaagatgtcagtgagttcttcagtcattggaaagcttgactgaggttgtaggatccacttctgaggttaaaggtcattcacatgactgcaagctagtgttagctgttggcaggaatccttggtttcttgccacaagagcttctctcagagctacttgagtgttcttaccctatgactagaaagctccccctagacaacctaacagtgagagggccagatggaagccatcctttttatgagcgagtcttaaaagtcacacggtgtggtgaatgcttcattccaagcaagtcactatgtttggcccacctcaagggtgaaggagggaactcggctccaccttctgaagggaagagtgtcgaagattttgtgggcgtattttagaacaccacatgggtgtttgaaatctgagctgtggatagggcctcccctctcaccctgtgtaggaattaatttcgggtacagcatccctgacagatggtcattcagccctctgcttgccacttccaactacgaggagttcactacactgtgagtcagtgaattccacttatatccagtgttaattgttagaagctttttctgttcatgaaattgaaagctctattgtggatattccattattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgcgctaagtataaagggacacagcaagggtttcctcactttgcgtaatagtggaggactgaaaaatgactgtgaaacctgaaataatgcaaagtgatcctagtgggaaaaatgatgatcattctgagacctttataaactgcttttttttttttttttttttttttgagatggagtcttgcactgttgcctgggctggagtgcagtggcacgattgttgctcactgcaacctccacctcccgggttcacttcattcttctgcctcagcctcccaagtagctgggattacaggcacataccaccgcatggctaactttttgtatttttagtagagatggggtttcactatgttggccagactggtctcaaactcctgaccttgtgatccacccgcctcggcctcccaaagtgctgggattacaggcgtgagccaccgtgcctggacaaaacatctgtttttaaaactttaaaacttgttaaaattaaaaattttatttcaaatttaaatgcaaaaattagtaaaactagtgttcatttagtattcattagtattctgtaattaaaatattacatattacattaaagatatagagaatttaaaatacagaggattaaaatacttttgcaaaagaaaaaaaaacaaaaacatcaatagtagattgaacagtgcttgccaactccttcttcttgtataactaataatacagagtgagtatttttgcttcggcaaattgtcatcctgcttttaaaatttgtatcagctttcaacattatatcctttgagctttcagtattataaaacatctctgagagttcctttaatgtgaagttgtttttgctggtatcatttccttggagatacctttaatcactatccacatttatgttgacaagttcatctttgctaagttcctctggctgtagactttagagtctctgacagtggcagtgaccacattgctatggttagctgtataattacatttaggtccgattcccacctcgctactctgttgtcacttttcacttctttgctgtactttcatgtttcttgaccaattcactctcttcattatccattcttataaaatgccacatgggtttactgctgggaagcaaggaagcaacacagctacatgctttgatgtcaatgtgtgacctgaataatagatgcacagtgactagccacacatactttggaataaggagtgtggttggttactgatcatgatgcacgtctgttatgtatgtaatgatttgtggactacagaactagaaactaagtttgcactttattcaattactcacagttaatataccatggtaattgatatttgaaccatgttgttaggggactggtattatttaactaaatcatggtattggaaatttatgtacatcagattcatgcaaagcaaagtctgcctgtaggcttacgaattggtctggagttggaatcgatatttttttttttttttttttttgagatggagtttcactcttgttgcccaggctggagtgcaatggtgcaatctcggctcactgcaacctccacctcccgggttcaagcaattctcctgccctagcctcccgagtagctgggattacaggcatgtatcaccacgcctagctaatttttgtatttttagtagaggcagggtttcaccatgttggtcaggctggtctcgaactcctgacctcaggtgttctgcccgccttggcctcccaaagtgctgggattacaggcgtgagccaccgtacccagcctggaatcgatttttatgggcgactgttctgtgctgcttattttaagctcctggtcctcgctgtaatcaagtctcatatgtctttacctatgcatttgaattgtgtaaaatgtaagtgtaggattttacatacattccatttagcttgtggctgtatttttgacattttaaaaattttctgatacataatatttgtacatatatatggggtctctgcctttttaaagctggattgtgctatctagtaaacaaactgtcttctccaaattgttatccttttcacagtaagccattagcaagaacatggctggggccgagctcaatgatatgtttccagagttctctaagagctctccagccatacttccctcatcctattaatcaaccttttaagtaggaatatatagcagctatgaatttctccaactctgctgtcatccagcctgacgttttcgagcttgtccaacaaagttatctgtctggtgccatcagatgcctttctgaaatcaaagcatattgtatcagtagtggtgtcctgaaatgccactctggttaccctaccaaaaattaacactatgggtaataccttatgtttacagagaacttttacagttcactggagtgtttggcatatctctattttaaaatattttgtctatatagagttgaagggagatatggcagatatcattactttattttcaaaaatggtaaatcagagaggttaagggattggctcttgttcacagagctagtaaatagcagaatcttgatccttcagtaaatccagtgtgtttgaccatttcaaactatctcagatgaagtgactacaggcaagaaaaagggagtttctgcagtgttttcctgtcgatttattaggacagatcagtcttatgaccctcctcctatagggtctgtgctggtttcccagggctgctgtaatgaagtaccacaaacagggaggcttaaacaacagtaatttattgtcttagaattttgaagtccaagatcaaggaatcagcagagttggtttcttctgaggactttgagagaaggatctgttccaggcctgtcttctttgctcatagatggttgtcttccctctatgtctcttcaactcattttctttctatatgtgttcctgtgtccaaaaggacaccagtcatactgaattagggcctatcctaatgatttcattttaacttgattacctctgtaaagatgttatctctaaataaggtcacattctgaattactggcggggggggttaggactgtaacatattaaattggggtgggaggggaggttcaactcataccaggtcttcaaggcagatttcaagtttttttaaaaatggccatccgggcgcggtggctcacacctgtaatcccagcactttgggaggccaagaggagcggatcatgaggtcaggagtttgagaccagcctggtcaacatggtgaaaccccatctctactaaaaatacaaaaattttccaggcatggtggtgggtgcctgtaatcccagccactgaggaggctgaggcaagagaatcgcttgaacccgggaggcagaggttgcagtgagacaagactacgccactgcactccagcctgggcaacagagcaagagtccctctcaaaaaaaataaaaataacaaaggcccaaaggaataggcttgtgtagggagtacttttgtgtgtgcctgcatttttaaatcaatgtctgtgtatctgatacagtctattgagatcaactttatggtcaattgatactgcctttcagtttttcaaaagagagagagagtgagtgcttttcctaaattaattcttagttgtctacttgctgaatgtagtctctgaagatgtcttttgtgaggcagctgctgaaattatttgcttgtttgatgatttcaggattcaaatgtgtcatttaactttagagctgagatttatggtgaatttcactccgagcttggtgttaattttacacacatctaagcagtttccttcttccacaagttggttaagcatcagaggattctgaatttaggaaaaaaaaataaattaggcagtaacaatttgcatcccaaagtgattcacaagttttcaagtatattcaagggttgtttagcatattaccgactacttatcaaaacacgggactgattatgaccttgttttagattgctggtgttgaggtgctacaaatgtgagatctgtattattgtgtttcctcattgccttcgcttcttctgtggttttttccttttggtcactttgggtgttccacagattaccaatgtgtgcatttcacatgaaatagattttgattttttaaaaatagcatttattgtgagtagaaaatttggtttcactcatacatttttctggtgatctttgtgcattttacttatttttttgaagtgattcttctttttaattaactcattgggtaaagaaagtacagttctaatgtctatgtaaggtgtaatgaataaggatgtgatgaactgtggttatctttgaagctctatgtgttctcaatatccgttcccttcccttatcaccattatactaaattttatgcttatcatgtccttacttttacttatactttcacaattttttttgtgtgtgtcacttgttgcttaggctggagtgcagtggcgcgatcttggctcactgaaacctccacctcctgggttcaagcaattctctgcctcagcctccggagtaactgggattacaagcgcccgccaccatgcccagctaagttttgtatttttagtagagacggggtttcaccatcttggccaggcttgtcttgaacttctgacctcaggtgatccacccgccttggcctcccaaagtgctgggattacaggcgtgagccaccgcgcctggcctcactatcttttttcactttcttttttttcttttagtcagagtcttgctctgtcacctgggatggagcacagtggcgtgatggtagctcactgcaaccttgaactcccgggctcaagcaatcctcacatttcagcctcccaaagtgtgggattacaggtgtaagccactgcacccagcctatactttcactttttatatttgcgtttccaaataatatactgtttagtttttcagttaaaattttttatttttaattcattaaaaaatgattcaaaaagttacaagaatatacaaaataatgctgctatagacttcacccggattctcagtgctaatattttacaaaatttgcttcattattctctactctctctacatatataggtagacacacacatgcacgcacacacacacatttttctggactgagagtaagttatagacatgctgttggagtctaaatactttattttttttccctaaaaaataaggacactgccttacataatcatgaattattatctgggtcaggaaattaacataggtataattctaccacatgatctgtagacccattcaaactttgcccactggcccaataatgcccttggtggctatttcccctcctcttattcagaatccactccagaaccacaggctccatttatgtatcacattcctttagttgcctttcatctgtaatgggtctttagtgtttctttgtctttcatgctctggataattttcaagaatatagaagagtttctccttttttcaaactgtcccttaatttgggtttgtctgatgtttcctcatgattagattcaggtcgtgcatttttggcagggacatcggagaaatgatgctgtgctctcagtacatcatatcaggaggcacaggatgtggaattgtcccgttattggtgatgttaactttggtcactcggctgaggtggtgtgggccagctttctgcacttctctttgtaaaataaactttgtggggagatactttgataattatataaatatcctgtttctcaacaaattttcacccactagttttagtgttcattgatgatttttgcatgaatcatttttttatgatgatggatgccaaatgctcattttctaattgtgtaatttcttccacatatattagttggtattccactggaagaaagaactctccattctcactcatgtactcattcatttacttatcattgtggactcatggattcccatattattctttggattttaatttgttagtatttttatttattttgatgctcaaattggcccagatttacctagtgggagtttgtttagagtggcttctttgtccttttgactactttctgactatattctagcacttccttacttttggcacaaaattatgttctagattcatcttgtattttccttaccagagccctggaatgagccctggagtcacttggttctgttttgtggagaatggtatttagaaaccaagatctgagaactaggggtgctgattgcatctgggtttcattgtctctaggcctctcagcagataaagctagtatgtgtgtgcatgtaatgtatatgtatgtatgtaaatatatgtaaatatatattactcctatatgtaatcaatctcctgaccctggggactgtctcctcggctacagccttgcccattccacctgcctccttgacactgcacttctccaaccccagttcccctgaccctattagcattctcagccttgactgctcccttagccccaactacctctgcattcctggatccaccaggcccacctgctggggctatatgaatggaaggaaaaggaaaggaaaggcacaaagaaatagtttataaagaaaaaaagaaaaggaaaaggctgtttggtttttaaaatattacatgaaaaaatacataacgtagtgtctaatggccgttagcctgtaggcaactggggttcaaattcaggatttattacctgccagatgcgtaattttgggcaaggtacttaacatctctgtgcctcaattttatcctctgcaaaatggggctagtaatagtgcctcatagggttcttgtgaggtttaaacaagttaacacatgtaaagtatgtaggatggtgtttggcacataggaaatatattttaatctctttattattatcagacatcccatcattttagaatatgttgctttatatttctaataaaaatgtgttaaataccaatgatttattagtggtgtcttctacagagatcagaagagttattaaagttaccgtttttccttccatgagtattattttctttattcagatttgactgtctataccttataccactttgcaacataagcattacattaaattactattacaaatcttgaatctttgcacttatcttttaaaaatttaatttttagagaagttttaggttcacagcaaagttgagagaaaggttcagagctttcccatgtatcccctgccgggacacatgcacagccccctcattatcaatatcccccaccagaatgctacatttgcaacaactgataaacctacattgtcacatcattatcaaccaaagtccacagtttatactagggctcactcttggatttgtacattatgtggttttggacacttgtataatgatgtattgaccattatagtatcatagagagtgttttcactgtcctaaaattcttctgctctgcctattcatccttccccctccaacccttgacaactactgattttttattgtctccatagtttgccttttccagaatgtcatatagttgggatcatataatatgaagctctttcagatttgtgtctttcacttagtaatatgcatgtaagattctctatgtattttcgtggcttaatagctcatttatttttattactgaataatattccgttttctggatgtaccgcagtttatttatccattcttctactgaaggacatcttggttgcttcctaaaggtacatccttcatctatcaaggagtgtttgttttctactacagaatgatacttgtaagccaccagagtctgtactctgatcaaataccaagggcatttgatcagtccctgacgttaaagaaaaatgttaaatgttatttccatttggaagctaatcataaataaatataaagtttcagagaaatgctagtgaaagccactgggatggttttcaagttatataattttaatttacatgcatctttttaggagttcatatcagagcttggcaactataggccacaggccaaatccagctccctgactgagttatatggcctgtgagctaagtatggttttaaaatgattgaaaaaaagtgaagaagaagaggaagaagaagaagattttataacaaatgaaaattacataaaatgcaagtttcagttcctgtaaataaacttatattggaatatagccatagccatttgctactatattgtctatggttgattttgcaattcagcgacagatttaagtagttcaatagacacaatatggcccgcaaagcctaaaatatttactgtctcaccctttagggaaactgtgctgatccttggtttatactattacagaagcaatcataaagttttggaagaatctcggaagacatgtctagtttaggagatatggcttcccctgcaccttaggcatttaaaataacctggcctgtttctttctgaaatgagaatattggatctgaagatctaagtccctcatgcctcatgctattctttgatgcctttgtaacattattcgccccattgtactagtccgacggggttttttcccccactttggtttttattttaaggcaatctcacttcatctctcttttccattaatctgtttgacatgaactgagctaatacggcaatttttgtctctgttcaaaaacttcaagaaattttgagacctcatatttttatctggttttatttcccctcacagtgacgtaagagtggattttgtataatagattgaaatatgttcttttattttgttggatggctgagctatttcacagtggctcaaagagcagtttactttgttccatagcaacaagcctcttgcccaaatttgccatctggtgtttgaagcctgtatcttgcagcagtttttttcattagctgacagccattactcatctgcttttggctttagtattcccgacattctcattattgctcatcctaaatagtcccagtttcaagtaagaaagcacttggagttgtttgcttagcagaagggaatcaatttcatctggaaaacaaggggccagttgagaagatacctgccagctgggaccatgactttattatttgtgaaacttggtttttaatgacttgtgtatatgcttaacagcccacctagagtgtggcctgtgaaggggaagaccaattggccatggtgggtacccactagatggtgaatgagtgaacgggtttcctgcataaatccaggaaaccttgggatgaaaaagcagtagccccatgaagaaagcatcaatcatactttgtaattttgccacatttgctttccaaattttttttagagattacctgaaaataaatctcagggctgatccctggctacctctgatctgatcttctatcagtctttcttgtagtccttgtactgtatccccactagcctctctggtgtttcagaacctgccaagcacactcccattttggggtccttgctagatattccctctgcctggaatgctcttccccaaatgtctaagtggttcactctctccttttatgcaagtctctgcttaaacctcattcttcagagaaaccatcacactccacattttagtctatttacctctctttattttcaccataaccctcactatgaagtatatcttcatcaatttattgttcccagtctctggaataatcctgagcatacaggaagcactcaggaagtactttctgagtgaaaacatgaacaaaagcaagacaaaaatctattaaatacttgatttgtgaattaaggttttccccaacccaacacttccgtgttatttacagaatactcctgtctatttcacatcttgtagctttttgcctctttgctgctcctgttgttaccccttccatcccttttcccacaaccctggatacttaccaagtaccaagtcctaccaaccactgtccaagttctgccttttctttgaaatcttcgctgatcacacttattatctctccattggaacccacagggccattgcacttcctcatcctcccttctcatgtctaattcattttctacctctgcctgtcttaactcctaaaccttaagctctatgagtagagactatgcatatatattcctatttttcatactttgcattttcatatacacttaatgcatatttttagtacattggctagaataagacatttattattaacaactttgtatctaaaaaggagtaaagatgaaagtggagtcactctcaacttctttcctaaagagataagcactgtcattatttagacacctgctatggtttgaatgtttgtcctctcagaaactcatgttgaaactcaattgccattgtaatactattaagaggtggggcctttcagaagtgattaggccgtgaggacagagctctcataaatggattaatcttgttaccatagtagtggttatcttgacagtgagttgttataaaatgactctggcctcgagtgcttccctctttcacatgctcttgcctgcccttccacctttctgctgtatgatgactctggctagatgctggtgccatgctcttggaattcctagcctccaaaacggtgagccaaacccattttgctctttatacattaccaatctgtggtattctgttgtagcaggagaaaatgtactaagacagaaaattggtaccaacaccagggttgttggaataatagatacctgaaaatatgcaagtggctttggaactgggcaatgagtaaaggctggaagaatttggagaagcaggctagaaaaagcctagattgctgtaaatggagcattgaaagtgattctggtgaaggctcagaagaagagaagactggggaaagttttgaacttcttaaagattacctaagtggtcatgaccagaatgttgatagaaatatggacagtaaaggctgttctgatgagatctcagatggaactgagaaacaaggtattggaaactggggcaaaggccatccttgttataaagtagcaaagaacttggctgaaatgtgtctataactgagggctttgtgaaaggtggaatttaaaagtgatgaaataggatatctagctgaagacatatttaagcagcaaagcattcaggctgatgcatggttacttttaaccgcttatagtaagatgctagaggaaaggaatgatttaaagatggaatttataatgaaaaaggaagctatgtgaaaagatttggaaaatttgcagcctggccatgtaaacaacaaaaaagcattctagtgtggaaccaagagaccatttactgacgagattaacacagacagaagagagccaccatcaatacaatgggagatagaccctgaaagcatttcagagatctttgaggctgccctgctcatcacaggcccagagttctaagagggcagaatagtttgaggggttgggctaggagcaacctacacaggctccctgcccagaccgacctcacatctctgcttcctgcattccagcagagagctctttcactgctcccaccatggctcaagcaggtccatgtgtggctcaggccacaacttcagaagatgcaagtggcaaatcttggttgcatccatgtggtgttaagtttgcaggcatgcagaatgcaagatctatgggggcatggcttcatccacctagatttcaaagtatgttgcaaatagcctggagccccaggcagagacttgtcacagaagcagagccactgcagagagccccaactatggcaatactgcacaaaaatgtggggttggggttagtgccagagctgccacagagagtcctcactggggtaatgcctagtggagccctgggagcaggactggcactgagactccaggatcgtggagctactagcatgcaacctcagcctgggagagcagcaggcaggagactccaacctatgaagcatgggctgggtctaggaaagccataggagtggggctgccgaagacctgtgtgcccaggatgcagaaaatggagtcaaagattattctctaaattgagggcttaaagtgttttttcccattgggttttggacttaattggagtctgttactcttctctttttgcctatttttcccttttggtccaggactgtcaatcctatgcttgccccaccattgtattctggaagtagataacttatttgatttcacaggctcacagctgtaggaatatgcctatggatgaatcctgtctggtgtctcacccacatctgatacagaggagactctagacttttttttttttttttttttttttttttttggagacagggtttcactttgtcacacaggctggaactacagtggtgtgatgacagcttactgcagccttgacctcccaggcttaagtgatcctcccaccttagcctcctgaatagctggggttacaggcatgcatccccatacctggctaatttttttgatttttttagtagagatggggtcttgctatgctactggtctcaaactcctgggcgcaattgatcctcccacctcagcctcccaaagtgctgggattacaggcgtaagccaccacgcctgacctgagactctggacttttgaattgatgctggaacaaccacttaagacttttgggactactggaatgagatgaatctattttaggccaaatacagtggctcatgcctgtaattctagcactttgggaagccaaggcaggaagatcagttgagctcaggagttcgataccagcctgggcaacgtggtgaaaccccttctctaccaaaaatacaaaagttagccaggcgtggtggcacatacctgtggtcccagctactctggagacttagatgggaggatcatttgagcctgggaggtggaagttgcactgagccaaaatcatgcccactgcactccagcctgggtgacagagtaagaccccatctgaaaacaaaacaaaaaaaagaaatgaatatgttttgtacttgaaaaggacatgagttttgtaggaccagggcagaatgctatggtttgaatgtttgttttctctgaaactcatgttaatatttaattgccattgtaacagtattaagaggtagggcctttaaaaagtgactgggtcatagggatgaagctctaatcagtggattaatgccattatgaagggagtgggttagttattgtgagagtaggttgttaatgttttctttccttttcttgtttttttgtttgtttgtttttgttttgtttgagacaaagtctctgctgtgttgtgcaggctggagtgcagtggcatgatcttggctcactgcaacctccgcctcccaggtcaagcaattctcctgcctcagcctcccaagtagctgggactacaggcacctgccaccacgcctggctaatttttgtatttttagtagagatggggtttcaccatgttggccaggctggtctcgaattcctgacctcaagcaatctgctcgccttggcctcccaaagtgctgggattacaggcatgagccacttcaccccgccatgttttcttttctctagcttactttagtgaagaatacagtatataatacatataatatagaaaatatgtgttagttaactttatgttgattatgtcgattatgttattggtaagtctttggccaacagtaggctattagtagttaagtttctgggaagtcaaaagttatcgctcattttagactacggtgctcctaacccctgcattattcaaggggcaactgtaatccccttttcttcttgaattactaattctattctacttccctcacagactttttactaatgcaatatatttttatacttgaaagccttctgttgatcaaccattgtagtaaaatatctgtacatagatttaagcatttacagtggcccgggaatataagaaaattaaaaaaaaaaattgtattacacgttttgaaagtaatttgttaagtgtaaaaagtttttttcatccagtttgataatatatctatgaatgattgttagttgttggtagaataaaataaggggcagcatcaattttttcttattttccatttttatagatgtgagttttaggaataattttaacataaatcgagtagatgcgaatggaaaaagtttcattgtagcaatatcattcaattctttgaacttgttatgtgataaatttacatattaatcaatcaaaaatatctttaatgatctgtcaattgataagcaatgaggacttctatcattttattgacagttaaagaccacaatgctagagaaatatcgtagggtgccaggcagaagccttggtaggggcacatttgagcttggtgactatggctattccatctactgtgctgcgtgccttgttccagtactgcatggctactcaggtgcagcccagaaaaagggaaagtgggactcagttatttttaccagctgtatgttaagtaaaagacaatggaaatatgaaataatagatagtgaaatctaacctcgacaaggaaaatggaggaagaagatggctggtggactgggcaaaagtacagggagaaagtaaagggaaggctcttttttttttttttttgagacggagtcttgctcttttgcccaggccagactgcagtggtgctatcttggctcactgcaagctccgcctcccgggttcacgccattctcctgcctcagcctctggagtagcttgattcttttcgcttttgttgcccaggctggagtgcaatggcgcaatctcggctcactgcaacctccacctcctgggttcaagtgattcttttgcctcagcctcccagatagctgggattacaggtgtccaccaccacacccagctgattttttgtattttttagtagagatggggtttcaccatgttgaccaggctggccttgaactcctaacctcaggtgatccacccacctcggcctcccaaagtgctgggatgacaggcatgagccaccatgcctagccatgtttctttcctcttgctgcttttaggattctttctttatccttgatctttgagagtttgattactaaatgccttgaggtactcttctttcgattaagtgtgcttggtattctgttaccttcttgtacttggatattggtatctttctctaggtttggaatgttctttattatccctttgaataaactttccatccctatctcttttcctacctcctctttagaagcaaatctatgagttattgaatttgtgggtttttagatcctataggcttgcttcattgttttttattctttttatttttgtctcctctgactgtgtattttcaaatagccttttttttttttttttttttttttttttgagaacgagtctcactctgttgcccaggctggagtgcagtgtcgcgatctcggctcactgcaacttctgcctcccgggttcaaacaactctctgctcagcctcctgagtagctgggattacaggtgcccaccaccacgcccagctaatttttgtagttttagtagagacgggttttcaccaagttggccaggctggtcttgaactcctgacctcgtgattcacctgcctcggcctcccaaagtgctgggattacaggcatgagccactgtgcctggcctcaaatagcctattttcaagctcacaaattttttcttctgcttgatcaattctactattaaaacactctgggccgggcacattgcctcacacctgtaatcccagcactttgggaagccaaggcaggcagatcactaggtcaggagatcgagaccatcctggccaacattgtgaaaccccgtctctactaaaaatacaaaaattagctgggtgtggtggtgcaggcttgttatctcagctactcaggaggctgaggcacaggaatcacttgaacccacgaggtggaggttgcagtgagccgagatggtgccactgcactgtagcctggtgacagagtgagactccttctcaaaacaacaacaacaacaacaacaacaaacaacagtctgatgcattcttcattatgccaattgtatttttcagcttcaggatttttccttgattctttttaattatttcaatctctgttaaatttgtctgatagaattctgaattatttctctgtgttatcttgagtttctttgagtttcctcaaaacaagtattttaaagtctctttctgaaagattacatatctttctctctcctggattaatccctggtactttatttagttcatttggttaggtcattttttttttcctggaatgtcttgatacttgtagatgtttgtgcctgggcattgaagagttaggtatttattatacttgtcactatctgggcttgtttgtacctgtctttcttgggaaggctttccaggtatttgaaaggactttggtgttgtgatctaagctatatctgctttagggggcaccccaagcccagtaatagtgtggttcttgcagactcgtaaaggtagtgccttgatggtcctgaacaagatctggaagaattctctggtttaccaggcaaaaagactcttgttctcttcccttactatctcccaaacagtctctctctctgttcttaaccacctgaagctcggggtagagtgacacaagcacccttgtggccacaatcacccttatggccacaatcactatgactgtgctgggtcagacttgaagccagcacagcactgggtgttgtccacagctttctgtaatcactccctggctactgtctatgttcactcaaggccctggggctctacaatcagcaggtggtgaagccagccaggcttgtatccttcccttcaggatagtaagtcaccgcagttccctggcagttctagaggtgccgtcagggagctagcgattagagtcgaaagacttagaaagccacctggtgttctattgtactgtggctgggctgaactcaaaccacaagatacagtccttcccactcttccttcccctttttgaaggtggaggagccttaccttgtgtccactgccaccacaggtcccctggaagtcctgccagactactgcctatgttcccttaaagcccaaggattcttagtcaacttgtgaattctgcctggcctgggataaactcttcagagcagtgggcttccctttggcccagggcagatccataaatgctgtgtaagagccaagttctggaactggggactccaggagcctgcttgatgttttattcttctgtggccgaactggtacctaaagtgtaagacaaagtaccgtttaccctctgctttcctcaagcagaaggagtcttgccccatagccaccacagcttgggtgaatgtgctgagtttcacccaaggccctcaacatagtacctggtattgctgctggttattcagggcccaagggctcttcagttagcaggtgacgaatcctaccaggactgagtcttttccttcaaggcatcaggttcccttttggcccaaaatatgtctagaaatgctgtcaaggagctagggcctggaaagacagtctcacacccctgacaggtgccctatcctgctgtggctgacccggtatccaagatgcaagaaaaagtcctccccacccttccctctcctctcctcgagtggaaggaaggagtctcttttggagccatgagctgtgtggcctggagttaggggaggggtgatgccagcactcctgcagccaccccaatttgtgtctcaggaggttgtgttcccccccttcccggcccagtctattgtctctgggcccagttcagcactaggactcacacaaaagttgtagtccttgggacctagactggcttttaagtttattagggcctctgggcactttagcccactgtagtctgtggctaggcttgtggaaactcaagtcccaactgctgggatcagcaattcccctctggccaaggctggtttgaatgttccctctgtgggcagacatcagctaagtttggtccagttttctttctgctataacagaacagcactgagttcggtggctcataattgctatgctctccttccaccagtgcccagaaatgctctccacaccacatcaccacgccctggggggtagggaaggggtagcatatgcaattcaagactggtttttgtatctcttcagtgcctctttcagcaagataaagttaaaaccaagtaccatgactgctcacctgatttgtagttcttatgaaggtgctttttaatatagttgtcaaattggtgtccttgcagggggtgattggtgaagccttctattctgccatcttgctccgcctctccaattagccatttttaataccttgtatcttcaattgagaatttttgaagtctcagattgatattatggcagaaaaggaggaatcacacacagcttgtctttggatgaccaaaagcaaacacctgtcttttttttttttttttttgcctctaaactcaattccatttggtatcaaataccttttaactcagctatagtctcttttaagaatatttacatatttaataaaaaacaaatgactgtgactcactaatatgtgtttcttttcttttctttctttcttttaaagatagtgtttttagaagaagcatctcaacaggaaaaactggccaaagaatggtgcttcaagccgtgtgaaataagagaactgagccaccagtaagttgttacttcttcccttttactgggtgccactaataagcttaaattatagaaaacctgccttgagagacagagagactttaaaaaataatattaatttaacaataattattttgtattaattatttgttaagggaggagatgggaaggagaaggtatacaggaagctgaaggatggaaacttagagagctagaggctgccatcattcatcaatttctttagcatatatttgttgagcatgctatgtgcagtactggagggtctggaggtgaaaaagatcttcaaagtccttgtcctcacagggtttacagtccatggaggacaaagacagtaaacaagcaaacagatacctgcgcatgaccatagtagattgtgatagcttctataaggaaggaaacaaggtggggaggggtatgatagaggttaactattaagaagtagggaggaaagaaaatttgagaatcaattggttggggaagttcagaagcacacttgagctgtgatattatatttcatctacttttagtggtttttaatattcgttatatttcatatataatatatatttaatatatgttatacagttcttaaagaaatgattgggccagccaggcatggtgtctcatacctgtaatcctagcactttgggaggccgaggcgggtggatcacctgagatcaggagttcaagaccagcctggccaacgtggtgaaaccccgtctctactaaaaatacaaaaattagcctggcatggtggcgcatatgatgcctgtaatcccagctacctgggtggctgaggcaggagaatctcttgaagcccggggggcagaggttgcagtgagccaagatcatgccacttcactctagcctgggtgaaagagcaagactctgttaaaaaaaaaaaaaaaaagctcagtttcctcatagcctggttgatatgctttatggaaatgggaaaactttttttgattataatttttattttattttttgtttattttactttaagttctgggatacatgtgcagaacgtgcaggtttgttacacaggtatacatgtgccatggtggtttgctgcacctatcaacccgtcatctaggttttaagccccacatgcattagatatttgtcctaatgctctccctccccttgccccccaccccccaacagaccccggtgtgtgatgttcccttccctgtgtccatttgttattattgttcaactcccacttacgaatgagaacatgcggtgtttggttttctgttcctgtgttagtttgctgaaagtcatggcttctggcatcatctatgtccctgcaaaggacatgaatgggaagacttttttaaagctaaaatattttatcttgtttcaggccaagtaagttccaaggccaataaaattggtaccatttatattctgaaaacactttgataacttgggaattgactttcacgtaatatagagaaacactgtttcacgtaatagaggaacattgaactaggaatgaaaatacctggtttgaatccacagactgtactgtagctttgcagatgttaaaagtcaagcaagccactttccctctttgaggtcatctagactatgaagctcatccctggtcatagtccagagagacagagtgactatttataatgtttcactccacctgcagttttactcacatcccttgcctccttccctctccctgctgcctctctatgggcttggaagtgtgtgggcgctgggcatggaaatgaatatagtagcttctgctgttaccatctacttcctcttgctagattttcatgtaagaatctatgatgaggagcaactgacatttatagtctcctgcttgcgtgtctttgtgatgcaggattagaagaaggcttggaagcagttgaagtagaggctgagatgggatgagagaatggtggaaacggttggaggatggagaggagggtaaacataactgtgggtcttcacttccttttcttcctctttatgaggttgcttttgaaattaaatccatcagaaatgcagattctgggggtcgtatgtaagtactgcacacaaggaagtagtaaggtaagaaataatttaaattttagtagaagactgaagtctttgaagaaagattatatttaaaatgcagagattcttatatcaagcacacaagttatgtgcggttgaatttaagtcatgattaaaataccataaagggatgtctcagacagtttttaatagacttggcccaatacacagtgtatctacaggtctatctcagtactgtctggatttttagaaaagggaaatcacaactggagtaccatgggcagtgctgtggtaggagtgaatcagatggtggccatggaccctggacaggtttgcagggccaggattagggtgaggggagtgaggcattcacctcaggcacaaaatttaaaagcagcgggggaggggcaaaaactcagtaatcaagataaatacttttaagacaatattttaaaatataaaaagtaatgcatggctgggcgcggtggctcaccctgtaatcccagcactttgggaggccgaggcaggcggatcacttgaggtcaggagttcaagaccagcctggccaacatggtgaaacctgtctctactaaaaatacaaaaattagccaggtgtgggccgggtgcggtggctcacacctgtaatcccagcactttgggaggccgaggcaggcgcatcacgaggtcaggagatcgagactgtcctggctaacacggtgaaaccccatctctactaaaaatacaaaacattagccgggcatggtggtgggcccctgtagtcccagctactcgggaggctgatgcaggagaatggcttgaacctgggaggcagaggttgcagtgagccgagatcgcaccactgcactacagcctgagtgagactccatctcaaaaaaaaaaaaaaaattaatgcaaaaactcatgatgaacaaaataccaacattttaaataaagacaagatgttgtttgttttacagccatgcattttttttgtgcaatggaacagtcactttcaaataacatggattctcaggcccatgatgccattgcattactggtagggcaggctgatgatggtgatgatggtttgggtaatacacacatgtattgatatatacctgtattgttttctgattataaaactttattaatgtgttccatttggtgaaaagataggtggatgttctgataagcatatatagggggatatatatatatataaaattttttttgctcaggttatgatacagcttggccaacactgcagatttggaatacctgggggaagttgagattctctgaggaaattatgatgctgattaagtaaagtgagaagaggaaagctgaaaagaagggagaaaggagagcttttttaccttctgctgctgccttcagatctcttctctgctttgcctgcagctgggcttgtagtagctacaatttagccataagtgatgttgtgagtggagaaccgagtttgaatcctagctgagccaccaacaaattgcaagtcaaaaataaacttgcaatcccagaccttccttttgttctctctataaaatgagcaggtgggctcactgacctctaatctcatgtgcactctcacattccatgcttctgtgtgtaccaatattatctgtaattaatcctggactgtaaccttgattctgggaatctttttattaataatcatttcacgatgcttactatttccttaaaaggattgtaacttttctgggtaaaaaaatcacacttcagatgcaataaatccttgcgcttctgttgcctctgaagactttgtactctgaatcatctttcactctctcatctcagctacaatgaacatgctcatttctcctacatgaaaaacataaagtgacttgaactcttcttcatcctaactttcactaccaaatattttaaaagggcgctctccatctgcacaggactttctcaaacactctctttttagcacttagtgcagtaacaaaaacattctagagactcagtgactactttttaaaggaagagctaaatctttccaaaattgggggtcttaggattattcctgaggccatgcatttttgacccttgcagtttttggcactagtcactgccctgctccttcttgaatgtctcttctttactgtccctgacacctctctgtcctgggttccctctaccctcctgacaataactctgccaagattgatcctgatcttttctttctcagtcttactcctgaagtcgaaggtgctgcttaagatgttggtttgttcttccttccacagagaactctggcatcgccaacttctagagttacctatataagaccctcaaatctgaatcctttctttttttttttttttttttttgagatggagtctcgctctgtcacccaggctggagtgcagtggcatgatctctgctcacctcaagctccgcctcccgtgttcacgccattctcctgcctcagccgcccgagtagctgggactacaggcgcctgccaccacgcctggctaatttttgtatttttagtagagatggggtttcaccgtgttagccaggatggtctcgatctcctgacctcgtgatctgcccgccttggcctcccaaagtgctgggattacaggcgtgagccaccgtgcccagcctcctctccttcttttcttctgcctcttctcccttctccttcttcttccttttcttgctcttcttcttccctcctcctcttcctcctcctcctctttttctccttctcctcctcctttctcgtccttttcctcttctcctcctctcctttttctttctcctcatttttcttcctcctcctctctgtctccctcattcacccgtaacctcctcaactagattataaagtctttgacgacaatatgccttatttttctctggactctccacagggcttggcggtttcctaaatatagtagacattgggaaatattatttggttaaacaatttaactgcatgaggaagttacactgctattccgttttatgacgggagagaaagcaaagacccaaaggactgacattgtagagagatcagtgactgatacctgagagaaatccatattccaccctccctttcagagtgcttcccacattataggcccacttaatgctgccttcttgacgtccttaaaaatttgtcacagttctttatttccatagtcagtgaattaacaattccatcacgtggaacgtagtgaccgagagtactgaacctacagacaaactgcctgggtttgaatctcagcgccaaagctgactagttaacagttactttttttcaagctacataaattccctgagctttagcttacccttatgtaaaggagggtaacagtactctcatacttactaagtttcttgtgaacattacatcatcatcatcatcatccataacatttattgatgctttccattatctaggcattgttcttacacacactaaatacatcctcatgacagccctatgatgctactactatctccattttacataaggggaaactgagtcacacagaatttttttttttttttaatatgtcaaatatctaactgctgatttatggtcaaacctgatttcagatcttagcaggccaaaaccagaatgtatacactttaactcaactgctgcccacagatgagatgatgtatgtagaacgctgtgccagtgcctagtgaatgtacatattcaggaaacattagctgctgtcaccatcattattataataactgactacaaaaaagctagtcttttccatgcgatgtagaggctttcttgtagtcagacaagatcaagatgaccactgagtctgccattccttgctcttgttttaaaataaagcatttagagttactcatggctttatttggcttacagttaggtggtatgtatacatttgatttgatagcatgaggaattatttgtaatgttaggtttcaagttcaagttgcttatgtgattgaatacttacctaggataatggtggcagtagagggtcccatcttttggcaaatatctgtttggatgaggttggatacttaatagtgactgtggtgaactgcattagctctttagaaaagcatgaagtgtctgttagcaccatactgcctcaattctgtgggtagtgcctctgaacactttccaggactttctaattataagaattaatagaaatatgaatattaattggtggatcatggtggtagcattagtgatcacaagcatcctgagcatggttgtcacagcatcatatgtaactccctcttcgcttcactacttacaccactgcccgtttgtggtccatctcctgagatcgcctgtccctaaccagcttgctcttgctgcttctatttcagaactcagtttctgtaacacgtgggaaaagactaggtttcttgtagtcagacaagatcaagatgactgctgagtctaaaattgcagccagtctgtttctcacctttagttgcccttagtgactggtgtgcacattgctcagcacggctctagaagttttaaaggcctcctcttccattcttgatctctgacctacaactatcagttgtgagaacaaagtcatgggattaaatcagagttcccgtcctttcttgtgccaccactgctttgcttctgctcaatgctgtgtttttccctcccttcgtcatcactggttaaccccgaccagccattccaacctagaagctatatctctcctagcagagcttcatttttatgtcctgacctctaaataattggagaatttacagttgtctgattgcattacctataaacctgtgtgggtgaacagtgaaatcatgcttgggaaaaaatgtgatttaaaaatatgggaaatgactgaagatattattaaatacttttattctcatcttaatttccagtgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcgtaagtatcttgtgtgtgagtgtggtattctgtttggtcatctatagaaatatcagtttcctaggacagatttaaattataaagcataagcagttaagcctaagatgggccatagagaatttttaagtttctttttcacagtccagtgagtttgtgaccacctcacctacacagctagtcagtggcaaagagagaatttgaatccaagtttccaaaaccccaatctggtgggtttacgttactcttttactttctgtgttttactttaccaaatctgggtttaatgaatatgtgtatttccctactcctgctaatccataatgctgttctgaggaccatatggattcattatgtgacctttgcaaagttatgtgactcacttttcccatctgtaaaaaatagagatcatgatagtacctatttcacaggattctcatgataattaagcaagttaatatttgtgaagttcttagaatagtgcctagcacatggtgggagctctatttgtttgctttaaaaatgcccaaggaaatttaaaattaaatatttaaattactgttagaaggaatatcatgttattctgggagctttgcaaggaaggaaaataggatggtcccatattgcatggcacgtggtaatgtgacttgagcactgacaccactagagggaactctggggctagtacagtcattgaacagtggcagtagtgtgtaccagccatatgttgaaggctctgaaagtgtccttccttctcctctttcaggaaaatcagttcctttcttactccaatcctgtgcccagaaccagaatctactcaggaattagaaacagtttctgcagtaaaggagctaaagcgcaaatgctgccttgtctgatcattatgtcctggtgttcagcgcacttggtctgaacactcatggatttttgtgggacccattgattcctcctaaggtgttcactacatgtggtggtggcagtattataagccttccacatcaactgacctaaccatcttgccagtttttttggtcttgcatcattccagtcttagagagtaaaagcaagtgctttttttttttcttcttttttttggagacagagtctcactttgtcacccaagctggagtgcagtggcatgatctcggctcactgcaacctctgctgcccagattcaagtgattctcctgcctcagcctcccaagtagctgagattacaggcacctgccaccacacccagctaatttttctatttttagtagagacggggtttcaccatattgctcaggctggtcttgaactcctgacctcatgatccacccacctcggcctcccaaagtgtcaggattacaggcatgagccaccgcgcccggccgagcaagtgctaacatttatacacttgcctcacgtaattataaattcagtgcaattgtggatcttacatatttagcatgcaccacatgacactagaaaagctgagaaggactaaagctatgtataaagtagctggtgcattgtgttaatgaatggtgttaaccacaccaaatctttattctcaaaatttatttatgcctcacattgttctaaaaaagatgtgagatagctgaaaattgcgtagtatacaacaaaagaaaatgagtcatgatatcaaggcaaagaaaaaaaagggggaaggaaaagtaaaataaaaccaagaaaacaatgtctactgtgggggtccatgcatttgttagtttgtcatgaatttggctttagatttctagaacctgacccaaagagggaaatcagttctgaaatttacactgcttttatgattaaaaaacacatttgttaaggtaaagcatatctatgcttcatactgaaacttaagaaaattaatctcaatattccttagtgtggatagacactatgctgccaaaatatatattgtaaagattctatactatcaagaagtccagatagatcattcttttatgtttagagaggtagagtatcaaagactatatatttttcaggcagtactccatataaattatttctgacatcagagatttgtttaagtatttgatgtcaggccgagtgtgatggtggtttaagtatttgatgtcaggcctgtaatcctagcactttgggagaccaaggtgggtggatcacctgaagtcaggagtttgagaccagcctggccaacatggcaaaaccctgtctctactaaaaatacaaaaattagctgggtgtggtggcatgtgcctgtaatctcagctactcaggaggctgaggcatgagaatcgcctgaacccggaggaggaggttgtagtgagccaagatcaggccactacactctagcctgggtgacagagtgagactctgtctcaaaaaaaaaaaaaaaaaaaaaattgcggagcacatatcctatgttctttcttatgtgtctgataatgaatgagtgtgggcccacaaacttttaagttggaggcactgagggtatggctgacatctgtttaagggtgtggagatgtgttaactagccacgtagcctactcagtgggatgagctcagtgggaataaacagtagtagctttgggtttccttcctcccttccttcttccctttctcaggggtctccctgtcctgtccctttactgtaattagggcacttcctgaactttctagtgttttcagttcattctagttgtggaaagaaaaacttcacacaaattaaatttaacagagtaaattgagcaaagaacgattccagaatcaggcagctctcagaaccaggaaaggttcagaggactctgcccagcaaggtgggcaggcagcatttaagacagaaaatggaagtgaggtatagcaacagcttgattgttacagctctgggtttgccttattcaaacttgttctaatcacttggcacctgtgactggctagagctcagctgctgtgattggctgagactcagctatttgttacaaaagcatattactaatcaggctttcagtgagttgataaactaagttaggttgcagttccttataaactcaaagttgagaagcatgctcaggccaaatttagcttgctttaacacagtccaatttgaagtttcaatttctcattcactaaaatcttctcccatataagccctgtacctcctggtttgggcctgacactgaggaaggggcttactatcagtgtttgtgtagtgcttctaaataaccccagctttccgtttcaatttcatctttaagtcaagattgtagaaaggtgcttaaaattttgaaaatttagaaaaatttagattacatatccgttttaattttgagttttattttagtttggttagtaaatgtaatgtgtcatttttcttggggatagctgagatttatgacctaataaaaggttaatttttatgattattctgcgattttttaaaagaagactgcattttctctgttgatttgacatttttttctatctctatgagatgaagttgttaaaagtcttgaacacttctattcttttgctgcatattctcccatatggtaagacaagaacattttcattctgttcccttcttcatccctaccttttttgctacgtcctatgttatatcatctgagattttagttccatttttttttgccgtgtatactatatttaagataatatttaacttttaagtttaatttaaaaaaattatctcaatttaattccagttttttattttaacatctgcacttaatttaacaatgagggccgggcacggtggctcatgcctgtaatcccagcactttgagaggcctaggcggacggatcacctgaggtcaggagttcaagaccagcctggccaacatggtgagaccccgcctctactaaaaatacaaaaattagccaggcatggtggcgggtgcctgtaatcccagctactcaggaggctgaggtgggagaatctcttgaacccaggaggtggaggttgcagtgagccaaggtgcaccattgcactctagtctgggtgacagagtgagactccatctcaataataataattattataattataatttaacaatgagctttgctttttattttgctacttggatccctgtcttcattcatttttgttggaatatatcctctgacaattctttccaatcaggtgagtgataaacattctaaaacctagaattatcaaaaatggctttactttttttttttgactcttgaacaatgccttagctgtagagagaattctatttgaaattatttatctatcagcatccaatgtgctgacatcaatgtgattctcatttctttctagttaattttctggcctttgagatttttttcttcattcctgatattctgaaattgtaattgttgatcatcccaattcattctcagtttaattcttcaattcattctctttaatacatagttctttcaataagagaacttctgtcttccttctgtttctaggaattctgttatttctctttctctttctctctctttctgagtatattcctctcttcaatctattcttccttttgataattactattagaaaaatattgaaacttctgttctgttttcatgtctctaaacttttctttcacactacattcttaggaaatggtatgggccagttttgtaaatcattaactcactcttactatttataataacctgttcctctttcaagatatgacatcctgtcctattcatcaaaggatgctatttttcattcattttatgtctcttgttgttttagtaattctgcttcctcaggtgttcattcagtaaatatttactgagcacatcctagaacccatacacttttctagttgctggagattaaatttgatacctttgtcatggtattggctttccacctggatttgtgatggagagctcatccttgtctgtaattgacaggttctaaacatcctctgctggtggccagatctttttgttttacatgaaaattatcttaatatttggaaaaattgacaggtttccaaattcttttgacttttggggctaaccaatattactgagttctcatttgcttttttgaaacaattgactgggccaggtgtggtggctcatgcctataatcccaacaactttgggagtctgagggcaagaggatcacttggggccatgagttcaagaccagcctgggcaacatagcaagggcttgtcttaaaaaaaaaatagctaggcatggtggcatgcatctgtagtccctgctacttgggaggctgaggtggaaggctctcttgatccctagaattcaaggttacagtgagctgtgatgtgtgatggcacctctgcactccagagcaagaccctgtctcaaaaaacaaaacccaaaataacaacaacaacaaaaaatggaacacactggatctaattagaggctactgtctaaggtacggcatgttcatttctattatcctaactccaaactatttcaatcctgcagacacttgagcttctgatgtctgtactagtcaagaaaaccctgttttttcacaaaggaggaaacatggaatgtaagcaaccttctcaaggtcacgtagctaataacaggcaaaacgtaagcaagagccactgtctggagggttttcctctgcatttaaaagcttctgctaaagatatgccccaaagtattcaatccactagtcctttttccaagtgctcagacaggtcaggcaatatccgttccattttctttcttgaagatcttctcacctcctcccattctcttgtttctggtcagcattctctgtagcactactgtaatcttggcattctctttgcctctttcctgcgtttaatgcccactccctggatccaggaattactttggattactcttgtgttttactaaaagacagtttctaaaagcttcctaagaaagagttcatggagagtaaaattttcaagtccttcggtacttaatcatatttctatgctaccttcacacttgattgataatttaccaaggtataaaattatatgttaaaaataactcctgttgtgacaaacaacttatatgtacttgtgggaagacctcctttttaattgctagaacatgagcattgcattttttgcaagtacttaattgtctgtgtatcactgtggcccttagaaaattttctaaagtacttagaaaatagaaacctatataatagagcgttttctattttctaagtactttaattatttacttaggatttttggttacagaatgatatatatgagttgaatttgaaggcattgttctgcttccagcattgttagtgagaaatccaatgtcgttgtgagtcctgtcatttatctgtgaccagtttttttttttttcctggagtttttagcatcttttctgtacttacgaacttaatatctcacaattatatgccttactttgggttctctttttattccctgtgctgacaattctatgaggattttaattttggagatgaatattatttttcatatttttgtcccttccatttatttaaaaaaatttagatttcttattctaaatgttggattgcctagattgagcctaattttcttatgttctcacctttgattttcatcttttccttttcctgagcaattctcttgtaatttatcctacaaccctcctactggcttccacatttcatttataatatttttacttttggagagctcctgcattctgattttcatagcattctgttcttgttttgtgggtgcaatagtgtgttttatttctttgaggatgtgagtcatagttgttttttttaactgagcttttttctgaccttatagattatgtttcctctaagattttttccagattctttctccccctccttatctttttgataatagattccctccaatgcctatcaaaccctggacatacattcatactgtgatgctataaggtgctgactggaatttctgggtggaggtatcacttgttgatggtaacttcattataggatgagtagtgaaggcagtgaatttgggtcccaaacgtcactgtgaagacatctttcttttagagccattcattttctctagaaaataatcgtttagtcccctgccaggagttgtgggagtagtacacgtggtattctggggaaaatgactgagtgcccttgaggtcagccagattttcacttaaacctctgctttaccttctcttttggagcttgtaccctctaaatactatccaggttctataaagagtaaatctctcttataaggaagaagttaagggtggttggctgatttcaacaaggttcctgccagggtttaatcatacctgcatagacttccagccagtcccctgctaaaacccacacacttctctccttctttccaagttgcttccaggttctcgtccatgttttttgtcttccaagaagatattgaaatgttttctctgctcatgtctctcctctcatgttcttcttgtgggttaataacgtttgtactcctttactgtcatgtttgttgtagtttgcgaaggaaaggagatagatatatgtgattaaccttccaggttgagctaaagtctggctgaatatttttattctgtagtagaagaaaaacttatttatgtactcccagatgcaataaaatttggatatccttaaacaatcctaagaaagaaggaattcattagtatcacattttaatgaattctgaagcacagaactgtgtgaatcgagaaaaaatcagaagtatcagcttctcctccagctaacttttggaatataaataccttttgccatttacctaactgtactctacatcaagatggcatacctttaaataaaaacattttaaaattaaaaactaaaattctgttttcctctggatgtaccatgtgacttttctgagcacacgtgattcgcggtttttgtgatttatttttagaggagaacactaaagaatggaacaaccacagcttgttactttgcaacaattcacactgactcatctctgctccttgccgacattacaggtgagcaaatgaagcatgatttatgggcacctcaagcaaagacagccagaccatcgtggcaaacaacttatatgtacttttgggcagacctgccttttaattgctagaacatgagcattacattttttgcaagtaattacgtgtctatatgtcactgtggcccttaggaaattttctaaagtacttagaaaatagaaaactgtatcatagagtgttttctattttctaagtactctgattatttacttacaatttttggttacagaatgatatatatgagtctgaattttgtgtattaatttagggctttttagggaaactttactaattctagttgtggtaatagtttcttatatcagcagatacatggtggctattggctagagtcagggcactgtgctagatgctggaaacgcaatgagataaaaaatagtctctgcccttgagaagccagacagaatacctacaccattgatcactaaccttagtaacaactatggtgctgttactagacgtctagcattgtgcaaagcactctggaagaattagttcagcagcaaacagccttctgaagtggttactgatgtcctcatgttacagatggttagactgacgctcagagaggataagtaacatgcccagggttgcacagctagtaagaagagctgattctggattcgggttgatgattccaaaacttgtacccagcacagtacctggcacatagcaggtgctcagtaaatactgttggctgatacactgatgccactgtttgcttatgcaaaagacctgacctaatgggtgactctgaaaatagatactacagtcttcagagaaggcaaagagaacccagaactacgacatctgggaaggctttatgaaagggtcctttaaactgggctttgaagtaaagacaagatgaggagaggacaaactgtcttctagataggggaaggacacaggtatgggaacaggagtgtcaatagtggatgcagggaccacagtagtttaactagaggagtggattcatcgcctgggggcagtgggagaagagggtaggcagatgggagggttcacattgtagaagagctcaaatatgcaccaaagactcaaaaaaggttctgagtccaggtgtgagtgatgtgatgaaagtggtattttaaggaagattaatctaatggccagttatctaaatgaattacaggggaaggagagaggcagaaaggtttttaaaaatctcttatgacagagatggagacactgtaaaaacaattaccattgtcccatatagcctcagctttcttgctgaaatagaattcttccagcacctttgatgaggactaggttctagtgctgagagctgctagtaagactgcgtaaaattcctcacagataatattggcattgtttcagttaagaatagtatggccaggcgcggtggttaatgcctgtaatcctggcactttcggaggccgaggcgggcggatcatgaggtcgggagattgagaccatcctggctaacatggtgaaaccctgtctctactaaaaatacaaaaaattaaccaagcgtagtggtgggcgcctgtagtcccagctactcaggaggctgaggcaggagaatgacgtgaacccaggaggcagagctttcagtgagctgagattgtgccactgcactccagcctgggcgacagagtgagacgccaccttaaaaaaaaaaaagaatagtagcagtatgttgcctagataaccacatgcctgacaccttatatatattattgcatgtattcctcacaaccctacacatagcagagaacactgtacatatataggtttagaccttaaccaaataatatccaccacctggagtaatcagaggaataaggaatcagtccaaatctttccaattccagtgctcatgttcttatccctcagccattctgtgttttgtctagaagaggaccatgatagagagagggagagagagagatccaagggatggtggtagagtaggagacaggagggagattgtaagttggggtagaagaagctgagtgtaggtatgccaatgactaagagagtctttctttaggacctgagactgtttgctcctttaccatgtgataaaatgagagcaaagatagttacatatttaatgaaaatatagacacactggataagcaaagggaaaaactgaataataacttaaaaacacccagccaagcacagtggctcacgcctgcaatcccagcactttgggaggcccaggcaggcagatcacaaggtcaggagatcgaaccatcctggccaacatggtgaaacactgtctctactaaaaatacaaaaattagctgggcacagtggtgcgtgcctgtaatccaagctactcaggaggctgaagcaggagaatcacttgaaccagggagttggaggttgcagtgagcccagatcacgccactgcactccaggctggtgacagagtgagactccgtctcaaaaacaaaacaaacaaacaaacaaaaaaaccaaaaaacccacctgacagcctgagaatggggatgggggaggtagtgggttaaagtgatgaatagaaaaacttttactgtttactgaatatagtagggaatttgtggtggttcttgttcttaagtggtgtgatggtggatgatcttttacattttcatttatgttttccatatatgattttaatttaaaaattactgttgaaagcttagaaaaagtactgttttggccgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcatgaacctgggaggcggagcttgcagtgagccgagattgcgccactgcaatctggcctgggctaaacagcgggactccgtctcaaaaaaaaaaaaaaaaagaaaaagaaaaagtactgtttcagaaacaaacatgccttcatattctttttgtgtatactttacagataaatttggacagcgggcatttgtgggcaaagtttgcatggatttgaatgacacttttccagaatacaaggagaccactgaggaatcgatcaaggaaactgagaggtaaaaggcccatttgtcttgatttgtcttacaggtgaattcctgtgctgcactgatggagttagagatggaaaaaggaaacaggatactgttatcacccagttgggatgtgcacatagtgactcagaatgttctgtttaatgcaatgggtcggttagtctacagtgaatttgatcaaacactcgataatcattaatgatttacaaagagctttcctttgtagtgccacacttgatcctcatagaaatctccatgaagcatctgtctttttatttattttttatttatttttattttttttttttgagacggagtctcactctgtcatccaggctggagtgcaatggcgtggtctcagctcactgcaaccttcagctcactgcaacctctgcctcctgggttcaagcgattcttccacctcagcctcctgagtagctgggactataggtgcatgccaccacactcagctaatttttgtatttttagtagagacggggtttcactatgttggctgggctggtctcgaactcctgacctcgtgatctgcccgcctcggcctcccaaagtgctgagattacaggcgtgagccaccacgcccagcccacatctgtcttttatgataaggaagctgagtctgacataggctaagaggcttgctcacagtcatacagcttttaagtagtggagccagaattcaaaaccagggtctatgactctaaattcaaagttcttttttttttttcttttcttttctttttttgagacagactgtcactctgtcacccaggctggagtgcaatggcgcgatctcagctcactgaaacctccacctcctgtgttcaagagattctcctgcctcagcctcccgagtagctgggattacaggcacgtgccaccacacccagctaatttttgtatttttagtagagacgtggtttcaccaggttggccaggctggtcttgaactcctgacctcaggtgatccacctgccttggccacccaaagcactgggattacaggcatgagccactgtgcccggctcaaagttctttctctcatgatatagatcacacctcatattcaatgtaagtaaagagaataaaagagagagaaacagagggtatgcaagaatacttgctatggcatgtgttaatttaaaaatgatgatggaagtgaataattatttgtgaaataaaatagtatacaagaagttaggaaaaatgagttatagttacaggttaatgaaagactttcactacaaaaggatttttttaaaagataccaaagtaatatgtgtttccatggtccagaacttagagaaacacaaaaaggtataaagaagaatttttttttgtaatgaaaccaccaaaagttaccataatagggtatcttttattgttttctcaaggtggtatatgcatccttcactactatttcgtcctaccttgggaacaggaaagttgttctggatgtatgctgtaatggccataacaggctaatatagggatctagaatatcccctctccacaaaggtgacctgaaagaacatctctgcaagctgaaatgcaggcatacaggagggaagatgtggttcctttttctgctttggttctacatctgtgctcctagggaatagggcctcactctactacctgtaataaaagctctgaggatgttatgtggtgacacaggctagagagagaccatgggagggaccaaggcccactctgctgctgctggacattgagctggattcccaaagattgtggacagcctactttggaaagatttccacctcaaagaataggataccatatgcagatagaatcataaaaagtaaagatgtgcaaggaaaatgaaaacatgtttccacgtaaagacttgcaggtaaatgttcatagtgacatcatttatagaagacaaatgcagagcaggttcactgcacataggtatcaatcccaggggaggactctaaacacctcaccaatactgcacaccacttgcatgaatctggtgagacagcacacttatacaacaagttaagcaaagcaagtttattatgcacagataggtagcaagggacaatagaagccttggtgaactgatcctccacggctcaggaaagttgcccaagagtctcatatgtgcatgccccacatcacatcatagctgagggaccctgtgagcatgctctacctgtggttttatacccagatgaaactggtctcactgagctaaaacattgcagaacatcctgttctaggagaaatgggaacagaacccaggctgttctgaccagtttctccatatctcagggtggttgcatttccagcacattctacagttattctgataactacaagtaagaaaaggggaaaaactgggtcaccaaggccatatgagaacttgtcctgcaccaaatagtggaaacaaccaaaatgttcataactggtgaatggataaacaaaatgtggtatacaatggaatattattcagccataaaaaggaatgaagcactgatacatactacaacatggatggtttttaaaaacactgtgctaagacaaagaaaccaaacacaaaaggccacacattgtatgatttaattgatatgaaatgtatagaaaatgcaaattcatggagacagaacaccagcgattgcctggggctggaagtaggaaaaactattttttttttttttgagacggaatcttgctttgttgcccaggctggagtgcagtggcacattcttggctcactgcaagctctgcctcacaggttcatgccattctcctgcctcagcctcccaagtagctgcgactacaggcgcccgccaccacgcccagctaattttttgtatttttagtagagacagggtttcactgtgttagccaggatgctctcgatctcctgacctcgtgatccacccacctcagcctcccaaagtgctgggattacaggtgtgagccaccgtgcccggcccaggaatagctattaactaaatgggcccaaggaatctaactggggtgatgagaatgttcaaaaactaggttatgatggtggttgtaaaacgcaataaatctactaaaaatcatggatttgtgcacttaaatcaggtgaattttatggtatgtaaattatacttcaatataaatagtttttaaaaatagcagtatgtgggtgagattgtgttcatgtacatttgtgttttctagttcacatccactttagataagagttgagtagaaagtgattagatttttttaaaaggaagattttgtacagaataaatagctgtgagcatatttgcagagactccagctctctgtgattttctcctgtggtacagtagtgcttctcttgatgcttctagcattcttcccctcacttttctcccttaatcacacattgttgaagccaaaaccaaaaaacgcctgagaagctcaagatgtattaacacactgcgtcgaattaaagttgaaagatgattaatgcactgaggcattcttcctatttgccaaggtcactgtgtgggtttgtccaacttgaatgtcaatattatttttgtgtaacaaattatatttaaagcctgcaggaacttgctataggagtcctagggtaaatcctcttgtaaaatgaagtaaatcatttaccctctccctaccctttattatagaccagggcttctcctgtagattggatttgcttttaagtacatatggcctgctcattaaattacttttggttgtgggtcatactatggcttgagattatgaattttcattatgttctttttcatacaacattgggagattctactgaccatataaatacttttcttatattttaaaatggcatttctatagtaccttaaggatttgacaagaaattgtattggtttatttatttatttttattttctattttttattttttttttagatggagtcttcttctgtagcccaggctggagtgcagtggcacggtctcagctcactgcagcctcccactcccgggtttaaacaattatcatatctcagcctccctagtagctcggattacaggcccctgccaccatgcccagctaatttttatgtttttagtagagatgaggttttgctacattggccaggctgatcttgaactcctgacctcaagtgagccgcctgcttcagcctcccaaagtgctgagattacaggcgtgagccactgcacctggccaaaatgtaattttattctgttcaacatctaagagatacagaagaaaatgctttagatacaaatctttgccaagaccaaacatattctgatgcaggttttagaagttcagctttttttctgttccccagacccctttccccttaaaagtgtcctctgaaaagggagcagaggggctgcttacatgctcacagagaggaggaagtacccgccttcctttagcatcagcctatcccagcttatctattaatccatttttgtggtgatagtaaaccttaattctcattttgttctgaaacaaaggaatgccagaaggcagaaaactacagctgcctagggagggcagaaagagccatttcatagtctttacagttgccaccatccctgcaggcataaactggtgggatcactaccatcccattccccatgcacctcacaaccaactctcgccttttccttctgctttactccaaggttcatccccaagagaactctacccttgtaaataaatggtgatgttgtgggaacaagtagcttccactttaggagaattcgaagtaaagagcttcatggcttctaaaagcctccaagtgcataggacttcatgactctaacaaccgtagagcataatatattgcaacatttctccaaacggagcttgagctagtagaacagcttgagtgctgtgggaatatttgagaacagcccgaccgatgctagatgataacattacgtttccctgtgattttgcactccatctctggctgcaagtaaaaaagcagagtaattactacttgttaatctttaattagtggtggtggaacatgtgcagcattagaaatgtttgcatgaaaatcaggatatgtaagaatcatgtttttatctttttaaaatgtttatttgaaaatggtcggccggtcgcggtggttcacgcctgtaatcccagcactttgggaagccgaggagggcggatcaccaggtcaggagatcaagaccatcctggctaacacgctgaaaccccgtctctactaaaaatacaaaaattagctggacgtggtggcgggtgcctgtagtcccagctactcgggaggctgaggcaggagaacggcgtgaacccgggaggcggagcttgcagtgagccgagatcgcaccacttcactccagcctgggcgacagagccagactctgtctgaagaaaaaaataataataaagaaaagaaaaaaagaaaatgctcaagttttctaacccatttgttgctttatttcagatttgtgtcagaaatgctccaaaagaacgtgagtaactttgttcagagctcgcttttagattgcctttgcattagctgtaggattcataaagttgcttgatagtgattagtctgtgtacgactggcttatctcatgcatgtagaagtatttacctagagcctgatgtgtcactgtggactgtcactgtcagctcagtgaagtcagacatttttaaaaaattatcttaaaatatttaattgacaaaaattgaatccactcaaggtgtacaatgtgatgatttgatatatttatacattgtttattgattattagaatcaaatttgttaacacatctattcccacacacgctgtacactagatcctcagaacttgttcatgttataactgaaaatttgtaccctttgaccatcatctccccacataagccagcaatcccacttttgggtgtatatccaaaagatgcaaaataagcatcttgaaaagatatctgcacttctatattcattgcagtatcattcagaatagccaagatatggaaacaacttaagtgtctgtagacagacaaataaagaaaatgcagtgtatatgtctatatacaaacacaatggaatattattcaaccataaaaaggaaggaaatcatgccatttgtgacaatgtggatgaacctacagcccattacaataagtgaaataagccagccccagaaagacaatactgcatgatctcacttatttgtgaaatctaaaaaaagtcaaacttatagaaacagaggtcaggcattttttgctttcttgggggcagctctgtacctagccctctgtgttttgttttaaatacattttgaaataatgaaatattaatgattttagtggatttgtttagatatcgttcacatatgtacaaacatcaaacttgctttattcttaaaattgtgtgtacttttcttggctcccaaaccccatgcctacatgcaacagaaaaactaaatttcgtcaggcaggtaaacttcgtcttaagttcactaagcttttagttgatccaatttttattaggacaatctcagtcactgctcaggttagagttaccgtctcagggtaggtttttcttcctcagtggttttccttacccccctctgggatcttctgatttcacaggattggtttctggcaagcagggacagggcttgatgggcgtgggctgactggtggcacctggaagttggggactgcttggtggccacctcaacattggctctggccacttgtgcccttggtctgctctgtaacacaggcagtgtctagtcctatgcccctgccactggctgtcttggtccctatgtgtgtgacacctcacatggcctgcaggcatgcagcaggcaccccctattgtggtcccctggtgttggtgagcctgtggagacaatgctgtttcctgcctccacccctaacaggctggcatgtggctctgtcaagcaatctcttagactggcaagcctgacccttccctgatcatcttttggggcctgataggaaatcataagaaatctcaaaatttctttccatctaactttgggagatttagatgaaactttgtagatccttatcctcactacccctctatgagtccttctctcctgcctggccactcacctcaggtgccaccagagccaatcctacaactgaatagtgctcaggaaggctgtaaccagcacacctggacaagatgtattcccaaaatggaatcggctatcacctcacttttagtctccccagcactcttttaaaacttcagcctccacttttcttcataaaggctacccagtctagccttcatcagagccttaatgtggtggcagaggagcatctgtcatttgggataggatcttttgttgaacttgggtgctgaagaagataccctcctttattctccactttgagctgttttcatgaaaccccgtacttccaccgactgttagaatggaggactgctccccaaaatgaagacacaaaatcatcttgctgtatgatatgcattttggggtacccttcacattcatgatatccatagtttcctttttttgaaaaaacttttaagttcaggggtacatatgcaggtttgtttacacaagtaaatgtgtgtcataggggtttgttgtgcagattatttcatcacccaggtattaagcctactacccattagttatttttcctgatgctctccctccttccatcctctacctgccgataggccccagtgtttgttgttcccctctatgggtccatgtgttctcatcagttagctcctacttataagtgagaacatgcaatatttgactttcccttcctgcgttagtttgctaagaataatggccttcagcttcatccatgtccctgcaaatggcatgatctcattctctttttatggctgcatagtattccatggtgtatatgtaccacattttctttatccagtctatcattgatgggcatttaggttgattccatgcctttgctattgtgaatagtgctacagtgagtgtatgtgtgcatgtgtctttataacagaatgatttatttccttttggtatataccctgtaatgggattgttgagtcaaatggtatttctgtctctaggtatttgcagaatcaccacattgtctttcacaatggttgaagtaatttacactcttaccaacagtctataagcatttctttttctccacaacctcaccagtatctgctatttttctgactttttaataatatccattctgactggtatgagatggtatcttattacagttttgatttgtatttctctaatgatcagtgatgttgagcttttttttcatgtgattgttggctgcatcaatcatatgtaaaacagtgaaaagtgtctgttcatgtgctttgcccactttttaattgggttgtttttttcttataaatttgtctaagttccttatagatgctggatattagacttttgtcagatgcatagtttgcagaaactttctcccattctgttggttgtctgtttactctgttggtggtttcacttgctgtgcagaagctctttagtttaattacatcccatttatcaatttttacttttgttgcaattgcttctggtgtctttgtcatgaaatcttttcccatgcctatgtcctgaatggtattgcctaggttgtcttccaaggttgtttttttgttgttgtttggttggttttttgtttttttttgagactgagtttctcttttgttgtctagactggagtgcaatggtgagatctcggctcaccacaacctccgcctcctaggttcaagcagttcccttgcctcagcctcccgagtagctgggattacaggcatgcgccaccacgcccagctaattttgtattttttagcagagacagggtttctccatgttggtcaggctggtctcgaactcccggccctcaggtgatccacctgccttggcctctcaaagtgctgggattacaggtgtgagccaccacacctggcccttccagggtttttatagttttcggttttacatttatgtctttaatccatcttgagttaatttttgtatatgatgtaaggaagaggtatcaattgtttttaattatctccagtattctagagtgaagcccatagtgacaccacgtttttccctctcctgctctgagactttgatgggtgaactgggcaacattgctaaaacccgtgatttgcacattcaggtgggtattcttcttctctttatgcctctatgcagacctgcaagatttctcagcacccttaaatcatcatttccaataatctgtagttgttttactgagtaatctgtttcttcaactgagatatcctagagtcacagcataacaggagagaaaggacccctgtagatatcacctaatccaattctttcattttgcagataagaaacctgaagttccttataccctcaatgttttctgatcagtcttctaaagacaagaaaatcgttttaagtagtggcaagatcaataacagactgtgatctgttctctgtaggatacatttaatgcatttatttcctacttctctttcacttgatactttctcagtgtgttctgtaccttcattcttagagaaaccagctattatttgaaaagcaaaaagagcctaatttccaccttacaaaatagcatttaaaatcccttttgttctgagtttcttaatttaaaatcagaacaaaaaagtataccttgctttgtcattaaattgttgcaatttaggaataaaacacttttttaaagcttatatctgggttaaaattgagagttccccttctcccatccaagcttaattacatactgtactaaaatttctcctcttaggagttgacggtcttataagaaaggtcagatcagggcagagacaacacattgattctttaccatttgtaaatcagtgtttttttggtttttgtttcccaaatctattttcttaggaaccattaaccgctctcaccttccctattattgttattattatttgcagcctataatttttgaatttttaattcagtcccacacatttctctgctggagataaaattcaaaacttacctgatgtttctgctttgcaaacaaaatgcttctgtcgccgacaaaataaaatacacatgaacatttaaaaatacatgaaaaataagatgagaagaacacacaacaaaatcaagtttatccttgctagagagatgcatgtggatgtatgcacatttactcacatttatccaaatgactcgaatcatcagattgtcctttcttctgttgctgtccatgcatttcatcggtggtctgggacttcctcaaggccagggatggagttcattgtctgagtaaaacacgtgttttcagaacattgctatttttttcttttaaaaatttagctacgcatattctaaatggcattgccattcttggaagtattaattatgccctcttagattttgtggtgccctagagaaaggtcttaggggcctttttcagtgtgggggcataggacttattgttttgcttgcatgtggattcttatgggctgtttcttgatgaccgtggaattttctagctcagctattttcaaactcttttttggagaactcattctggaaactaacaaagggcacagaatggagacagggtcccagagtctcaatcctgctgcatccggaggggcagtgcttttatgccttctatatattgggtttctgtgaatttttatatgaataatatattcagtgccgagagaatttggaaaatcactcatctagcccaacccttttttttttttttttttgaaagatgggaaaattgctgtccaaagaaaagaatgactttctctaggacacatagctgtcagaacttgggccaaacccagctctctttactcaaattccagtgttcatataagtgaaccccactgtctgcttttttatgaacactgagctcttttcttaaacggccagtatggccagtcacggtggctcacgcctgtaatcccagcactttgagaggctgagcccggcagattacttgaggtcaggagtttgagaccagcctggccaacatggtgaaaccccatctctactaaatatacaaaattagccaggcatggtgacacatgcctgtaatcccagctactcaggaggctaagacaggagactcacttgaacctgggaggcagaggttgcagtgagtggagattgtgccactacactccagcctgggcgacagagccagaccctatctcaaaacaaaagaaaggccagcaccagaagaggcaggttgctagggtcctgactatcttcaaggaggacttcatatttgttccagctggaggtcagaatttgaaaagactttgttggaaaaatttgtcttgatattatacatacacatacacacccacacccacatccacacacacacactacatgttcataatattcagtttctttgtcatatacattatattatctatgatgaatataattgtttctaacaaaatgcatgtgtaatcttcattgcctttctatgtggtcccttaaataggcaagtagaaaaccattcacaccattttgaggtaggaagtgtaatttctaatggtattttacagaagaaaaatgaaaatattatttttttcttgtagagccatataagtgaaaatcgtgatgaagttgaagctgtgaaaaacttataccccagttataaaaactacacatctgtgtatgataaaaacaatcttttgacaaataaggtaagttttatatcatgacataatctgtttaaaggagggcatatttatctcaattttaaaatctcaatagtaatcttcagatttctgatatgaatacatttctttaaaaattttttttaaagttttaatttttgtgggtacacagaaagtttatatatctatggggtacatgtgtatacatttcttaaattagagtaaagcctagtgtgtgtgtgtgtgtgtgtgtgtgtgcgtgtgtgtgtgtgtgtgtagttaaaaatggacccgaagtttcatcttagtgaattaaatgtaaaggcttcattgaagatgggaatgtcatttggtccaaggacattttaacagtatctattagaatgtaaacctacatttctttgagtcagcagatgcatttctaagaattcactctaagtaatatgaatagggatgctaattttatattaaagtttaaaaattgttatcggtgagggattaaattacagagcatacataggattttatccagcattcacaaagaaagaggtatgcaggcttacaaggaagaatgtttgtgtaatattatttgatgtgtatgtacatatgtatagatgcatgcttacttagaaaaaaactgtctgaaagacacaacttgagtattaaaaatgactcttcctgagggacaaaccagaaggactttctgctttttatttttaaatactctgagagtgcttttaaaaaatgagtatgcattactcctataattaaaattaatatgtgtgaagagacctcattacaataatgtactacttggccttggccttcaatgaaatgtacaaaccgcatggagagtttaccatagcaaataatttcttagtgactgtgtgaatggagatatgaatataactgatttaaaaggttaatactttgcataaatcatgtaaaagctacaccatagttttcattctttatatattttccatatgattaataaattaaccttccatttgcatgttaattttatttgaacagagattgggaaagttatattttaataataattctgtagtcactgggccgggcctggtggctcatgtctgtaatcccagcactttgggaggcagaggcaggcagatcacgaggtcaggagatcgagaccatcctggctaacacggtgaaaccccgtctctactaaaaatacaaaaaaattagccaggcgtggtggcaggcgcctgtagtcccagctactcgggaagctgagataggagaatggcgtgaacccaggaggcggagcttgcagagagtcgagattgcgccactgcactccagcctgggcgacagagtgagactctgtctcagaaaaataataattctgtagtcactgaaccgtgcctctcaaaggggaaagcaagttgggtacaggttttgtactgagagaaaaataattttgaaagagtaaagtcttatttaagaaaatctacaaataaatactaccaacattaaaaatttagagaggtctcatgtgtgtgcagtgcctgctttcttggatcaattttactttctgaattaatgattataagatgttaaatttcctagtttttatgaaaatataaacgtaggtgagttaaaagtttatttagttgaaaatatcaaggccattggcacttacattgaagctaggagcagaaataaagaacagcgctttgcaggattactctcacagctttcacatactgagaagggacttttagttctagaaagtttttttagaattggagcaagcacaacactaccagttgcttcccatataaacttagaaaagaaagtaacttgacagtcttctaaagtagagatgagaaaatcatgttatcttccatctggatggatattctgtgctgtagatcacctggaccaaaccctcattactttatagatcaacaaaaagaatctaagtaaactccacaaatttcctgagactttcgtaagacaatgtgtttacaggccttttctaaggtataacttgtacctagcaactttgtacatatagatcatcataaatgttcttgtgaagatgctaacagccaagctacagcttcggtctctctctaaaataccttgtgagtgagtacccacttaatcatttgtgagcggtaaactccacgtagggcactcttctctccagacagtgatggcacacggctgctacctctctgcagaagaactgaacgtattccatgaacgaggagcatccatcgcacactgtcccaattctaatttatcgtaagtagacaatgattgtttggtagattacgaatgattgggttgcagattagcagccaaatgcctttgtttcctctgtcattcctccaggatctcccctctattctgtgtttggcaggacccagatagatagacatttactcgtgctgttgaggagtaaaagagaacacgtaagaggacatttatctcagaggacacgtgaagagcacagcatcttctgaaatctctgagtttgtacaaaaaaaggacaatagggaatacaacataaaaaatttacagtgaaagtactgaaagaacccatatgtcagccaggaaatccagaagagggtagtcactcccattactgtttgtgctgtagtgtgagaaggaaacacagcaataccaaagcaaatgcactatgatgtatgttaccctgttggacctgacggaatgccagcccacacaggcaagcccaggaggaccttgtcctattataattccccagaatacagaggtgttatttattaactggttcttaaccttttgaaaggtgatggatccgtaaatgaataaaatgaaagttattgcctgggcgcagtggctcacatctgtaatcctagcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagaaaacaacttcaggggtcgggcgtggtggctcacacctctaatcccagcactttgggaggccaaggtgggcggatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattacaaagatatatgtcagtgtcattatgggaagggtgctgagagccacagtgacatatttctggagtgctttagggaccccagaggttctgagttttcagacttaaaggagtgacacagggaatcttgtctatgtacagcttagtgactataattagggtctagttacttgatagtggaaggatttaacacccattgggtgttaatatcctctaaattaaagcataatctagctttgcaaattgagttttgaagttaaatttctttaggacacatttctgtttaaatggtcactgctgttctttctccagcaactgagagatttattatgtatgcaccagggctttcaaaattagagttatgtgcatcttccagcaaaccactttgacctttgcaactttttagaattctaaggatcaccttagttttcctttgtctctttagaaaggcagcacatggtgggcatggtggctcatgcctgcagtcccagcactttgggaggccaaagtgggaggatcacctgaggtcaagagttcgagaccagcctgaccaacatggcgaaaccctgtttctactaaaagtagagactggacatgctggcgggcacctgtaatcccagctactcgggaggctgatgtaggagaatcgcttgaacctaccttgaaggagatggttgcagtgagctgagattgtgccattgtactccagcctggatgacagagacagactctgtctcaaaaaaaaaaaatatatatatatatatatatggctggcacatctctttagctcagagtcacaaggtcccaaattcagcccaggaaccatctatcctactttctctgtcttcagaggcagcgtttgaacagtcaggtcctgactttttaggctgcacccctttttctagttgtactcccctttttcgatcttaaagtcactactcattcagggtaacaaattattccaggcagagagaataggtaatgctttataatttctgcttcctaacataaaaagatgtgttggttagaaaatattaaagacagataaaagacttttgtattaattgcaaagtttgatttcttcatttttttcccatacaaacgatcccctgcttttccttctggctcttgctgctttgtgcccacctgagattaaccttggcccaaggattaggctattttatgatcctgtttactccaggacttggatggtctgatttgactaatatgtttgtgtcaacattagagccgatatattgggaagcacaattttcagtggcatcaccgtcattgttattagtgttcatcttttattggaaccacatggatctccttgttctgacatctcctctctctacaggctcagcagtggatttctaaatgtgctagaagtcctgaaacatgaagtcaagatagggctgggtacaggttagtagttcaccatttggagctatggcaaagtggttgattactgtgtaattttctaatgtgactaatttgcaggtgactgttctgtttaaaaaaaaaaaaaattagttttgggccgggcacggtagctcacgtctgtaatcccagcactttgggaggctgaggcgggtggatcatgaggtcaggagttcaagaccagcctgggaaacctcgtctctactaaaatacaaaaaaatagccaggtgtggcagtgtgcgcctgtagtctcagctactcgggaggctgaggcaggagaatggtgtgaacccgggaggcggagcttgtagtgagctgagactgcgccactgcacttcagcgtgggtgacagagcgagactctgtctcaaaaaaaaaaaaaggaaattgtatgcaaagggagaagttttgatgatactgacctcctgaaagctgttatccctgtttattattcaaagattaggctataaaggatgattaattccttctgacgtgtttcagaggtattctaaaaagtccttgacttttgttttgttttgttcttctggctaggttttaatggtttggatttctatatttttagttttcaataactgtcattacaaatgctgtctcaaaagaaatttttttgtccttgccatagtgagcacagattcaatctatgacagaattgagaattcggatgtatgttaagaattggttttgcttttaagcaacgtttagccaaatgagacctctccatatccacaggcagtctgcttgtctactaggctgagggatgttctaagtgcatatgaattagtgacggattagtgatgtttcctttcttcacagtacattttaattgtgtttcttgagagtgtgcaagcgttgcttgcttcgaaagtgtgagtcaggcccaaatttctaggtgtcctctgtgaggcttcttttatgactgaatgactgaattaaaaatttttttaatgggtatggggcaggaggacgtgttttctgttcttgatgcctttatcttcctcatatttaagagcatcaggctgtatgcatgttgacactggtggttttcatcactttctgcaggaactcaagtctcagtttgttatagtgagacattttacaaagtaattaactggtaagacacaataatacgcataatgattttactgatattttgaaagaggtatatattagattagaagtttttccctattttatgggaatcaaagtaatcaagattttgaaaattctaatttaagcctgaaatcatcaagattgtgataattctacataaagtcacaggtgttaaaggaggaaaccagtgattttatgttcacaaaaaagcttcaagggataagaaaaaaatggccaagagttttggttacacactatagtcagttaatatgaaaaatttagcagacacataaaaatcagtcagatattgttttcagatattctaggattttggtctccataatttaagttcatcacatgacttccttttcttgactttggattgtttagtgatggtctataaagttcaagttgagttctagctgtcacttattatctgtaagaccttgagaaaattaattttctagtagtttttagtcaaggattcatttcctgatttctacaacaatagtaactagcaattacaactatgtctatcttacaagctgtttagagaattaaactttaaaatgcatgcaaattggttagcacagtgcctgcctggcacatgacacaaatcaatcaagattggcttaaaaaggaaagggcgaagttggtgtattgaccaaacgtttgaataaatatgacctattagcttatttactcagaggatggtgtttcatttttacctagtcctttttgcaatttagtcaccctctactctactatttcctaaacgtgacttttgtgtatcaatttacccttcaatttgtaaactttagaagattattatacctcatactatgaatagagagcaagtccaagagcaattcacacaccctgtctataacaagtgcaggcagatcttgacttgcacaaatattaggtagaagaaacccacatgaaatttaacagaaatatagcaaaacaagataaagtgatatcacaaacaataagaatgtgaacaaatatctgaaaatgatctgctttaggatccagaagaaaatttcagaaaattgccttcatccctggagtacaggaaatcatggttctatgaaaagattgtggtagaaattttagaaatcaaggaagaaaactgaaaaaaatcagattaaaaagcacatagactctcatacactgatggaaggagagtggatggtacaactactttggagaatgttttgggagtttcttctaaagttaaatatacgtctacatatgacccagcaattttactcttgggtatttaccctagagaaataaacatatatgtttgcagaaatagttgtatgaggcccaggtgcagtggctcatacctgtaatcccaccaccctggaaggccacggcaggaggattgcttgagctcaggtgtttgagatcagccttggcaacatggcaaaaccctgtctttacaaaaaatacaaaacttagctgggcatggtgacatgcacttgtaatcccagctacttgggtggctgaggcaggaggatcgcttgagcttgggaggtcaaggctgcagtgagccatgttcatgccactgcactccagtctgggtgacagagtgagaccctgtccctaaattaataaataaatgaaagaattgtatgaggatgtttatatcagctttatttataatagccccaaaccagaaacaatccaaacatctatcagcaggaggatggataagcaagttgaggtatattcatataatgaaatattatttagcagtaaaaaacacactacagatatatgcaaaatgtgggtaaatatatgccagtgtgtgggcttaaagagcacacactgcatgattccatctgtatgaaactcacagaccaacagaactaactgatattggtagaaatcagaaagtggttgccaaatgttgtaggtaagaatttggggaattgacaggaaaaggccatgagggaatttgctggggtgatggaaatgtttaatatcttagtttttttgcaaaatagttaatgctatataattgttaacattctccaaactgaacatctaagttatatatgtattatgatattttagttatacctcagttaaaaaaatgacaaacccaccaaccctgtaggaagctatgagaagcagaattattgttacagaaaatcaaatcagtgatgtgagaataaaatcaaccaaagatgatagaaggtgtttgaggatgatcgatgtgaagcccagaaaccacagagccaacacatggggtttttttctgatggagcacccagaacaaatgggacagatgcaatagtcagagctttgaagggtaaatcttttctgagcttaagaaagaactgccttgcaagtgcttaccctgttttacgctaaatcgtaactgaacatgttgtgacaaaatattttaattacaataaaaaaatttctacaatattgacacaaggaaaaaagtcaattatcaacaaaacaattaaaaaccagtttgctttcagatgtttttgttggcacacaaaataccaaaaggcaagaaaagagtttggagacaaagcagtgttagccaagaataatatatctggccaaattctcctttatgtaggaaggcaacaaaattctcagctatacaaaaacttggaaaatattttccttaggaaccctttgaaaaacttacttgaaaatctacatcattcaatgaaagatgaggcaaatgaagggccatggggggaaataatggcacaatatgatgtcatggaaagctaacatcaatcagaataagaagatcaaagaattgtaaaggagtttaaaaaatgaaagtaaaagccaaaaatatatctcaagagagaataggcacaatgttaaaaacctatcagaatggtaacataaatcaggaagatgtttccctcaggctggaaagaggttcctgggaccgaaatacatggcacttattttaaaaactgagtgttaggtccttgagttttggttttatgctttccttatgtcatttgaatgtcttcagtattttatcacaaaattttaaaaaataatatatgctctgccaaggaagaattttccaagtataatacataattctgtcttataattttattaacaaaacccaagaagttgtagtttatgtgtaaggctgagaggaggatgtatttggcaagtggccaacatggtgaaacacatttctactaaaaatacaaaaattagctgggtgtggtagcatgtgcctgtagtcccagctacatgggaggctgaggcagtagaattgcttgaacccaggaggtgaaggttgcagtgagccgagattgcaccactgcactccagcctgggtgacagagagagactcaaaaaaaaaaaaattccttgtctcagaaaaaagagaattgcacatattttacttttgacttttcagtataaaaatattagagataactacttgaagaattttaaagataggatacctcctatgtgaaatatgaaaaaaaccataaaaacaaagaaaacatagcaaataaccaaaaacactcatctgaaggaaaaatttaaacatatagaacaagtttactaaacaagacctataaactcattaaaacaagcaacatacatggagccagtgcctcacttttcagtgacaattccctatcctaacttacttcttccattattccaaaaacaacagctctttgatctcttgtagactctagtccaatgactccatgctttctcaaaatccattattctaattcgaattcttagatgtcagagtacatcactataatcatttccttggaaacattctcgcttttcatattcccctcattttctttgtattcacattgcaaaagctccacccttgattatctcaaaagtccccttctcagtgcctgcagtggagcatctggaggttgctggagaaaatcctccagtgggctttcattttaaattttgttctcaaatcccaaatggcccaccgcttggggattagagacagttattagtctgtaataagcgtatatctcctttttccaagacagcgttttctcatttcttcttaaactttctaccccaacttctagtttaaggcctccctcatatcataagttattgagaaatagaaacgaccagaaatccttccctcaatctcccaccacgaaattcacacacctttctgcatctgctgggattttctcttctttgccctgttgcagcaaaaacaacaacaacaaaacccttcttccaatcaaaggcaaaaataccaaaataccccgacgtgtgttctgtattctttccctctcccagcatctcaataaactaattcctttggccatagaccgtcctgtatcatcagtgtctccttcctgctggatcattcctgctggtacacaaacatctctagtatcttcttttaagcaaagaaacaaaaccactcctatttttttttttttttttttttgagatggagtatcattctgtctcccaagctggagtgcagtggcacgatctcagccctctgcaacctcagcctccagggttcaagtgattctcctgcctcagcctcccgagtagctgagattacaggcgtgcaccaccacatccagctaatttttgtatttttagtagagacagggtttcaacatgttggtcagtctggtcttgaactcctgacctcaggtaatccacctgccttggcctcccacagtgctgggattgcaggcataagccaccacgcctggcacaaaaccccttcttaatcagacatccccctcatgctcctgctccacctgtctgcctcccttcatggcaaagcttcttcaaagagtggggatccacactggcaccactttctaggcccttttcccttcctccaccaacttcagtctggattcttgccccaccctccgtgacaactgcttttgcttttttctcctgtgggtattaccactggaatttctgctgccaactccaaaggatgccattctgtcctcatccaatgggacttgtcagcagtatttgccatgattgactgttctctccattgtccaagtaatcttatcttgaatcctatgaagcaccttcgttcttcccttctttctcttctctgaaggctgattctcttcctctgggccatttgaaagcttgcttcaagggtcagtctttggcagtctctttgactttacacattcttcttaggaggtgccatccacaaccatggcttcatgtgatttaatatactcagatgacacacaggttcttatatccagcccagacttctctgaattctaaacctatgttttcaactgactacattctcccttctcttagacccctcctgaaggaacccccgaacttcattctatcccaaaacacatttaaacctagttctctaaaatagctctcctttttagagaattcatttttgctaactggaaacttgatcattatctttgggaccttcttctccctcacttcttccccagcacaatgcccaacctcatgactccttagtatctccttgaaccatcccctttcccctcattggtcactaccacctgatgcaagctgccatcgtttcctgctgaactgctgcaccagcttcctaatgggtctcataccatcctaggcccttccagtccattgtgatttacaaaagaatcacaatgaaaatctgatcatgtcacccccttgtgctcgtcacccttcaatgcgattttgagtgtgtaaggctcattacaaggcccacaaagctctgcaatggtttgacacccatccactgcccagcctcatctcacactactctctcctcctcaccctggctatcttttatgaatagatatggcttttatgaataacctgactatcctctctataaatcatactcccttctctcaaaagtcctgtatgcattgtttctctgtctgaatgcccttttggcctctgtttatatggctgagttcttctcatccttgttgtagtttaaatgtcattgccttaaagaggtcttccctcaccatcctatcaaaatgggcccttcatctccattttctttatcactaaagtgaaaacaacttattgttaatatatgtctgtttatatgattcttttctttctccccaacaagatagttaacttgctcatgtgggaagcccataggttttatttacaagtgcttaagtaaatcaagcacatgcaaggagtgtagtaaatgattgctgaataagtgaatgaatgcataggaaatgagcacatacctatgaaatcattttttaatctttccattgtcctctggcttaagtttttgctcttgcataattttgttagagtcttcttgtaaataatagtgtccaaatgttggctctgacgagcaagtaatgataccatcttcattgtgatggtcctgggggagtagtggggtaagggggcagatcttctgagaaaatgcttcaattttccttcctcctccacacagtttccaccctttggtcctcattcttcagcacttcagttatgtaactgaattttctctgcaattattaagatatgtgatgttatttctattttctgagaaaattgagattcacaggtcctaagtaactgatcaaaggtccgcaaagcaaaaagttccatgcgcacagtttaaaaccaggtctgtaaaatgtagatattcgtgatttctctttctatcctaccacagtgcctctagccatatgacaaagtagggattccacctacattaaatgtgttgtagatggaaggggaaaactacaaagctaatccagtcgggaagaatcggcaagttactgtcacagtggaaatccctggaaaaaaaggcttgactcttactaaataccatgaaattatgcagcccagagttctttctttgatgagcacaaaattgttttttggtttacagttattttactgacataacattggcaaccagaagaatataggatgattaaatcaacatcataaggcatctctcaatttttttccagtaaattgcatagcattatttcctaatttatacttattctttctgtaaggttaattttgagtaggtatttaggaaaatgctactttctgttatattttataccttatttttaaaactgcaggtatttaagtcttccatattcataccatcccaactgcattgctttcatttctctatgtttacttccagtcgttacccatatattataaaatatagttagtctttacatattttataccacatagtgatataatttttattccacctttatttatatttaacatttttgttgttttagcaataaagaaggaagcagcagacagactatttcaaagcttaatgtgtgtagttcccaaattgtatttgttttcttagtatttgttttcctagctatgataaaaatgaagatttaagggatggttactacatattaacacagactagtaacttaagtagatgtaatgaaattttttagagagctgggtgattctctaatttaaatacaagtttaaggacatgtaggatagttgaacataaaattgagctacaatctagaattactactaaataggcaattattttgttttggcaacatatatagaggcactaacaattacatatgtctacctagaaatgacagaaggaacacttgaaatatgaagcttactttattagctataagtgtgtttttctttaataaaacatactaacttacttgaaatttatttatacaaactcacttaactccatgttcattcttgttaaaggtagtatttcatttgattatgattagggactttatttaaatcactaaaatttcattcttcatttaatgatgcctaccaaaatatagagctgtctacattagcactgctcatttattacactaatttcccaaaatatacaagtttattctaaaagctcttcataaaaattacaaagaagtggctttttaatttcccaaagttctcatctggattagaacaaggttaggataaatttttagtgaatagaaccatgagcttattttaaaccacatattatctaaattatctttataactatgcaggcatatttcaacaatttctgtgagagttcatggactcttcagagataagagtttcttttggctctttaaaccatttgagtattgtggtgggttgaattgtgggtccctaaaagatgtctatcagaatctgtaaatgtgacctcatttggaataaaggtctttgtagatataattaaggaagagatctcaagatgagattattctaaaatagagtgggtcctaaatccagtgatcaatacccttagaagagacaggaaaagagagacaaatagaagacacagggagaagagaagaaggctatttgaggatggaggcagagattggagtgatgctgccacaagccaaagaatgccaggagccaccaggagccaccagaagctgggagaagcaaaggagaattctcccttagagctcttgtggggatcatggccctgccaacactttaatttcagacttctgacctccacattgtgagagaataaatttctgctgttttaagctagaaaatttgtgataattagttgcagcagctgtaggaaactaatacaagtatgcatttgacactaattacagattttgaattgctttaaatcttagtctacgactatcttgtgtttatagttaagagctttttaaaaaaagtatattaaggactgaatatctgtcataaaaacaatgttatatatgtattattccatttatcctcacaaggttactgttttggttttattttacctactgcagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaaggtaatgactcttacatttttctctcacacaatatacaaccatgctgatcggtgtctttggatgtagtatgaagatgcatgattggtattaggaaaatccaatatttgtgatgatcacatctcatgtaacatacccagaactcagccagtaaagtgaagttcactgaaggaggaatcattccttagtgaattcactgtctttggtagaatagatgtctgagacacagttatcatattaattgttttaatgggtattacattggttacatggatatgagtgctttaaaataatccattcttaggccaggtacctaagaatcacagtaacttacgtctgtaatcccagcactttgggaagctgaggcaggcagattgcttgagcccaggagtttgagaccagcctgggcaatgtgacaaaaccccgtctctacaaaaaaatacaaaaattagctgggcttggtgaagtgtccctgtagttctggctacttgggaggctgaggtgggaggatcatctgaacccggggaggtagaggctgcagtgagcagtgattgtgccactacacttcagcgtgggcaacagagtgagaccttgtctccaaataaataaattaaagaatccatttttccactaagtcaagtaacttgctctccagtggcctaagtgatgatcataatagtaaaatagtagccaaggcttacttaagctcttcccctgtgataagaatcataccacatactttatatgtgttgttatttaatcctcaccaccactgttattcatttcgttttacaaacaagaagcctgagtgaggcttacacagctgtcaagccacagtgtgctatgatttgaatccacctaatctgatgccagcatgcagatttcttaccttctgcccttccactacagtatcttcctgtataaatccctgccaagaccatgcatttggttcatatacttaagtacactaattactctttaaaaggataaagatgtaaaaatttagttggttgatatgcaaatattgctcatcaacttttcccaattctcacgtgtaactgtattgttacggaaaaaaataaaaattggtcactgtatttctttaagtcactttagaattatacatgtaatcagaatggatgatagtgaaacacagcatgaaaccataggtagctagtgagaaattaaaatgtagatatagatttagaaacatattgggtgtagatttatgatagataccctgagtcttacaaatgaaggatgaccgaagccaagattatcctgggaagagaaacttctcagatgttctctgagtgttggggactatgatgaacaccataagcacatttcaagaaaagcaaatacaatgttgttttttgtttttgttttgttttgttttgtgatttcccaaagtattatggttcattttccaaaatcccaagtttcaaatcacccactattttaataattgttacaacctttcacccacaccaccattgtcttttcacatctgaatctgagtttgagtagttattctaccatctatgtttgtggtacaaacgagttgtatttaaagagtgctttttgaattctagggctctctgtaagttacttcatcaggatcctgtttctttgatcaagtcagcatgggtgcctaccaaatcatttctactttgctgtgtagcttttaaatctattttctgggtcactgggcttactcatggaatttcttttccttagtttgtttctctactatagtcagagtaaaatgagatgaatggatctgtatttaaagtgtggcattttcccagaactgccatggcctttacattcattctcaagaagatcaagatgagcagaaatgatcttcacagaaccaacatttactccaaaggcatcaaaactctatttcctgaaatgcatttgagtcacttaccagcccagtgggatctctgtgcaacaatttgaatttatatcagtttacaaattcactgaaaagaattgtgtcttttttggttagttcattcctgaagtctccaggctctactgaataacccagttggtttatatataccatcaaacttgcctaaaccctagtcactgcacctggttatctggcctattaaatgcacagtcagtaattcagtttaattcagttgaattcagtcattaaaaactcatacttgacatgtttctttgtcaagggcaaaaagaagtcaagtaatcagtgaaggaggagagaatttccagtgattttctgttacattcagtcctttcccatacaattagtagaagtcacctggctccttttaacattttggattattttcatacccctgtcttgctaaagagagtactttagctaaaaagccatttttcttttctgagaataaaagagttgccctttaaagaatcttttaagaacaagtaagatttctgagtcagtgtttagagaaatgccacaacttctggatacctataggtagaaatataatgtattagatattgcctaacaaaggtagtcgattcaatattttcacatgaaactttatcttagcggtgatagaatgcaacaaatacatgtgaaaattgaaataaggctgagcacagtggctcacgcctgtaatcccagcactttgggagtccgaggtgggcagttcgcgaggttaggagatcgagaccatcctggctaacacggtgaaaccccatctctactaaaaatacacaaaaaattagccgggcgtggtggtgggtgcctgtagtcctagctactcgggaggctgaggcaggagaatggtgtgaacccaggaggcacagcttgcagtgagctgaaattgcgccactgcactccagcctaggcgacagagcaagactccgtctcaaaaaaaaaaaaaagaaagaaagaaaattgaaataaataatactgcactccagttaaccttccatgcttccatttgtgaccccagtttacaccttcctcagattacaggctttaaggaactttagagccaatacctctgttggcgaagaaagccaactacccccatctttctgaaactaaatcataataatgagagatgttcttccttgatatccaataatcttggaacatgaattgtagctatgagatgagccaagtcaatagatattattggcctgtgctctattttagaagaccattcttctctggtgaccagaaaacctttgaggttgcaaagagattggtctgttttcaaaagcattgagacttttgagttatgagaatctgttcattttgagaagtgaggttttttttccattcaaaggatttaaactaaggaatttctgatggatatgcctgcattgacaaatatgcaaaaggataattattttttatttattcaaggttcatttcactgccatgaaaataaatcttgtcagctatttcatggaacagaaagaacaaaaaaaagcaaggcaaggagttggagtgttgggggagaatagaagggaaaaagaataaaggtattatgttaatcatcatgttgcttagagggataaatgaaaagcatagaccagctgggctatgaagtgcactgatagagctgaaatagagacataccagagttatgatacagtaatgaagggaattgttttcattctcagattttgctttcctgtgcttactccactttatgtaagtagaagtcttgtgacctgttagaatgagagtgattttctgtctcactgttaagatactaatttttttttttctcctagcgacatgttggcaaaatctgtccttacaaactgagacattagtgtggtctgatggcttgcaatcctgactgtttattcacttgttctcaatagccctggggctggatggtgagattggaaactttgaagtgggcaaggaatttgatgccatcctgatcaaccccaaagcatccgactctcccattgacctgttttatggggacttttttggtgatatttctgaggtaagtaaaagaaagttaatcaaaaggcatttatttcataaagtcgtcataatagcttccctgtagaaaagaaaatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 260 - DNA, 102874 bp, Homo sapiens; identical to SEQ ID NO: 259
  source 1..102874: mol_type = genomic DNA

SEQ ID NO: 261 - DNA, 102874 bp, Homo sapiens; identical to SEQ ID NO: 259
  source 1..102874: mol_type = genomic DNA

SEQ ID NO: 262 - DNA, 148110 bp, Homo sapiens
  source 1..148110: mol_type = genomic DNA
ttcccatgttttcttttcactaattttatttatattaggtagttttcactcagaatatcaattcatttttcaggtttagatatatgtatatgtagctgttcgtatgcattaatcacttagaaactttatttggtataacttcacatttttggtatatagaaattttattttcttaatgcagcacagtagacatacaatcaatattattccctagaatgtgcaatatataaattattcacattaaaaaattaacagaaagcctcatatgcagtaaatatttaaaaatgtatatctaactttgattctgtttctgactatacactactagctttataaatctgaatgaatatgacatttacacatttgaatgaagtacacggatgggtccattccagatgcttattacaccgtatgaataatctgctcttcactttggtcattaaggttccatgtgctgaggcatatagtggatccgaaagacacttccaggaagtacatttattacattggcatcttaagaatttctgttccttttattctcctttatagcgagggggccttttctctttaaaagcaagaagaccttcaagtctgtcttttgttggaatggtctaagaaaaacaaaatattaaatatgtcaaaaatgttaaaacaactgtaaaagtttatcaagcactatctaagaaaactacttagaaccacattctaaaattttgaaatcagtcacctgaacaattctcctaattatgtaaccaaactcatccttcttactccaagtggtcctctaccccattttgctcttctttttctagtttcctaataaggtggaaggttattatcgatttagatattttctcttttctattatatacatccaatgctatttctatctaagcactgctttcagtatatcccacaaactttgagaagttgtattttcattttaattcaaaatactttataattcctcaagacatctctgacatataacattatttagaaggatgttgtttaatcacccaatattttgggtttttccagcagtctttcttttattgatttctagtttaattccattgtggtctgaagaataccttgaataatttctggtgtttacatttagtaagttgtaatttatggccaaatgtgcttttaaaatttttctttgggctctgaggctatttctaagacgtttgtaattcactttcctcatggcacgtactcatcaatgacaggtggtgatttatatatacaagctgggcacagagtcacactctagatactgctcctttaaacgagtgctcatgcagtttccaactcccaggaaaggtagaacaaaacttttttgctatttcagatgccctaaaacaaagttctatctttcagagaaagacaaaaaagggaaaacattttttttttcctctccaggaagacctaataatttgtatgcagtcatccctcagttatctgcaggggattggttacaggacctcctgcagatgccaaaatctgcagatgctcaagtcccttatatattaataaaattgcatatcatattacctacgcacatcctcctgtatactttaaatcatctctagattatttataatacctaatataatgtaaatggcatgtacacagttcttatactatattgttcagggaataataaggaaaaaagtcagtacatgttcagtacagatgcaaccatctttttttttcctgaatattttcaatttacacttggttgaatccacaaatgcaaaacttacagatgaaaagggccgactgtgtaaaaaataaaactataatttcattagtgaactttcagtggtcaggagagacagatcagaggttcaggaaaagccaagcagtctcaccccaggttgcatggcaggcacacgctcatcaccactctcctctacctctctacattgcagtgggaggccaggaccaatcccacaaaagaaagcataagcctagagagacagctcctgcacacccaggactgactcagttactctaagagttttctagattatatagacaagaggcattcctgtggaacagaatcagtcataagagctggtaacaaatagcagaaacaactaatttcaacccatttgtatgattttggaatgggcgcaagggtaatcttgctcagtgaaattcatttgaattatacagaaggtaaatataatttgtaagggtcatcctcattgaatttgtgattgcattacatacctgagcataacaagcttcttctatggctaaccctgttactaaatcgacctgagaataaaaacataatccatttcagcagaaataactttgcgaaatgtggtatattcaacagaaattcaaattgaataaccttatccccaaagcacccaatcctttgatatagtacagcagatcagagtgtgaccaacatgagacacagaaccaggcttcctgggttcgtcctgactccctcacttgggagctgagttaccttggggaagttatttaacctctctgtgcttcaaagaggcatgtctgaacaaggggctaattataatgctcaccaaatgggagtattgtgaggattaaatgagttaatctaggtgaggcctttatgtcgcgacacacacacacacacacacacacgatgcttaatacatagtaagggctatataaggtatttgctattggtattgttaccattatgtaaatatttaaataaaccaatcaaatacttttgcaaatttatgaaactgtatttactgttatacagtattgactgtataaagtcaatctctttttactgctatacagcccaggaagatgcggaggttccttagtctaccaagaaggaagcacttttcttcaaaatacccataagttacccaaaatataataactgccatgaaaagtccaataaatgggtatgtgcaccaccccctcctcccaggcctggggccttcactcttttggagtcatctccctggggtacccccaggacacacaatggattcaccttatacctgcattgcgtgtgcctccttgtagaaggcacactgagaagctaaaggtggaaagagctagctgttcttggaatgttttgtataatataatactgatgctaaaaatgcacagaatgccctgttattttggttttctatgaactactagccaataaatctgtctgttaactggatggcaagaataatgagcatgtcataagcttcagggcactggtaaaattactgaattctgtgcttgtgatactgaattagcaataactgtaagaatgaaataaatgacgtacttgcaaggaacttcagtagctttcagtaatagtagcatttaaacaaccatattttagaactttaaaaaaaatgtagaagtctaaacatggttcatttaaattaaatctccactctccattcccaaaacaaactcaagcattaaggaacctacctccatcccttgattaattgctaattttgccactctcattgcaacaggtccctaaaattcaaattaaagaaacagacttcaattattttttatgcaaattatgtcgtatatctcagtaaaattcagaattcccaccactggatccattgcacagccagcaatggctgtcagatactagatggaaaattttctgagccttgcaaggctgtaattaaagagcaactgcaacaaccacatcagcacattatttagattccacatgttttgttatgctgcaaactccggatccttaaaggtgagcaggtagtgcatgtccagctgtgagcttgctgttcttcagcaacacttcctagaagttaagtagaggaaggaaaaggaggtagtctttgcctcagtaccacaccaattaggggttttgaaagaagcttgggctggggatgaggctgttgctattgattaaggtagggttctgatatcatctccttcagacactggctatatttcctccattcgccttgacaactaacagcaatgatggtggattaatcaacagtgtcctctaagcagtgctcccacagcacacataaatatgaagtctacataagtctttcaggatgcagaagagtcacaaggaatgaactggatatctgttgtgagaaggagaatgttacctgtgtcttgcagaagccaaactcttaccaagcagaaaaaccagaatccctcagatggaatttcattattggatcacattttaaagtcctaaaataccatttatgggtaataaatgtgaattcaatgctatattttgaactgaatgctcttttgaattaaaacacaaggtaggctctaaacaacaggcacagcaaaggactcttggatggtgacatggataaatgcatgaaaagacatgttttcctatcaaggagtttctattattaaatttgacctatctaaattttcttccaaatcatgtttacaaatctttttcaaaggccacaatttccaaggctatagttgttagacaaatatcttattgataattcttcccactgtgatttgtatatatcatagacaccaccaccatttttttcatgataatcaatccattttattaaatggtgtgctcctctaatttttccattttcattgtcaactgaccaagaaaaggtgcttgtcaaactcctagatgcacacaaatccccatcctccttgttaaaatgcagatgtggactcagtgggtctgagatgggcctgagattctgcacgtctaacaagctgccaggagatgcccaggctgctggtccacagaccacactttgggaagtaaagtttagaaagccatgagaaaaacaggaaaattcaaaatgctattagaaatagtgcttgatttaatttgtttcctccttaaaacatttccagtgccttttcttctttacaagcctttttttctcagataaatggaagtaatatataatacagatatcacctagaaatactgattttacaaaagctttcagttatctggaggactaatcatttggcaacaaagtaacaaacataaaaataaaggtgattccactcaaacttcatttggtgactcgtgcatgtaattttgcagtcacatattttctgaagtaactcaacatcttcttatacatcaacatcttcttatttgtttgacctggaggaaaattaattttaacaatcaacattctgaaggagtgtccttccaatgaaaggtgacaaaggcacatgcacagggactgtgatgacggctgggtaaccacacaatgggatgcggctcgacacactggcagtggaaggagggagcagaggagaggacagtgctcacgttctcaggcggggcggtgtgtggacggtggtggcatttgctgcatggtggccacagaagcatcatgggagagagagcaagtcaggccctaaggggctaataagctgcctatagggagctctgaagtagagagctgaacatccatgtcaggaggccaggagcgggctctgcagatcatcagaattggaactgtgtcataacctttcttaaacacacccctttctttcaactgaggtatgttctggtcataaagttttaagccaaggtaagttataacaccaatattcagtcagattatactctcctgatacttgtacctttaatttgtctttaggtagagacttctctcatatttgggaagaataaataagtttgtagtgagaatcttatctttttaaggcaaaaatctttttttatttgctctgtttccatcaatccaacaaatacttattgagcatctactgaatgtatggctctgcactaccttatgtggggaataaattatataatggtccttccctaaaagagctaacagctcctaagttaattaagaaggaccagaagcatcaatgccaggcagtgtggttttaaaaaccgattcagcaggtgcataccagcagagtggggactggtttgtcagcaaaggctcctgtgctgagtgccaagaacactttctgaaactggatgcaagactctgaacaaatgtgagcattcatgcatttttaaaaagaatcaaatgcatgaatttggaatctcatggcattcccaaaaagatccacagcccacaaaaaaggttatgaaacctgtttgagttaagcaaccctgagttagagagaaaaattattttgactctagaaatggttagggggttataaaacttcaaactccactaggaataaagaagatcactactgcttacacagcaaaagaagactctttctctcaatttaaagccctttaatcttgtgatttcagaccaaaggcatatttgaaaaatatatctgaacgggtgacaaaaagaattgcttaaagcaggactgtcagtgcacggccactgatatcactcctgagtcagccatacgcatcatgttctagatttgaaagtgtagttgtgaggaagcacaatggagtcaaaacaacgcctacaccaccataggcaaacacacagaaagacaaacaactgctgcttttcaagcaggcttttcacttttcaagtgaagccactgcaatggaagtccactctggcacaacagactacagtcccttactagaaaacagcatatttcaatgtattttgacttggggtggcccagtgtgacagccagccctatcactctttctttccatggctatggcttccattagagtgctcagctggtgagcaaattaaaacaccttgctaggaagttgtgcacatgtgacaagcattgtcaagggatattttatcaaagtgtggctacaataagacccttggagcatcttcaaagcgtcatcagaattccacaggatcatagtgtttatcttgtgtaactgctctagttttacagagcccacgcatccctttacttggaagcaagccagggacttcttccataggcaagatgactgctgttttagtcaaagtgttataatgtttcctaaaatgagaaaaaataaactcatttaatgagaaatacctgaggtaaaaactctctcgccaggtccaaggccttcctgtaggccgcgtctccctcctggttctgttccagaacgtggctgattaagcccactgctttggcttctttgccatcgaggactcgcgcagagaatatgagctccttggccagggacattccaatggcgcgtggcaatcgctgtgtcccccctgaggggtgaaagagagagaaaaggcaatgatttgacacctgttagttttaacacttcagtgtttcatatcttcatttataaaaataaaccagggccagaagtttatatgttaaaattagtagctggaaaactacttcagaacagaatctaatttcttaattcccctataaaactaataacaccaaaaaaggacttgagaaccttacatccttattaagtgattttggcactgagtatcacctgcaacctctctggtatacactgagtccaatccacagtcatcaccccatcagtaaccatcaggtgaacagcagtggataggcagtaccagccagtaagtccactgactagaaaggcagagttccaccaagcttggcattcttctttcagcttaaataaatcttaacacattgtgagacattcaactcctgttcttttaaagaatcctttatggcgaatacattgtaaacacattttaatctagaaataaaaccagacaatgactcatgaaaacaggctttgtcctggtggtattttctcagtgcaagtcctggtcatctccgttagctcttctctcggagacgctctctcacacaaacacaccccttttccagctggtgaggaaaatccactgtgtgtggagtcagaagccatgcatttggttttgacgttgtcacttactactttagggacttcgggagttcattaactcttcaactccaagggaaaacagtgggtatattagcatgatttagggtaaatgtaggtcagaatagttctacagcaaaagatgcttattttgttgaagatagcctaactcactagatccatctatgtattcacttcagtatcttccagtgatgaggacgggatctcattaaatacaaagttgggcaaaagcaggtaacacaggtctagcctcaatgtctaccaagaagaaatgaaaacagcttcaacatcagcattcacctaaatctcaccctatcaatggctgtgccaagaggcagaggagcagcagactgcccccttgcagagcaggaaaagcaaactgacgcccaccatctacacaagttcactgggttttacttgacctacaaaatttaaaacttttctttctgcattagttagcaacatttaaaactagatgagtgattttatcttaaaaaaaaaaccaatttacctccagtatttttcctttaaaggaaagcaaaatcattttttgttcacacctctatgaaaagtggaaaaaaattaaagaccacaagaaggcacatgtttaacaaagtatgcctcagttggaagaacagagcttaagatgccattattaagcaaaccatgttaagaaccgtaattaatatttagaacacaggtaacacttagaaaaagaaaccctgaatgaattgtaaaaggactaatattttcaatacagactgttttcaaacaaatacaataatgctaccgcaaaatgcagttattacgtgtttaagctgcccaagccgttagagatggtgagtttatataagtgtttactcgatacggcagaaaatatgtgtctgaagacaatgaattattgacaaatttaaatttaactttcgacaatgatgttgctcagtgtagtaaagataggtctgagaacttacgggataagctgcatggaaaagacaagctatttatggtgcttccaatggcagctgattagaacacagatataaatataactcagataactatatttactcatggagctgatgagaattttgatgagactgaagaacttaatgaatatatattattcatgataagcatattaggaaatggttctttctcatgttctatgaaaagtttaatgtagactggtcacaattaacaaatgtgacccacattgttaatgtcacactttttattcaacagaaacaacattttccaagtcccggaagctcaaactcgttcatcatattgttccacttatagcatgatcctgaggtatgaggatttttgcagaaacttaacaaagtaatggtcatgtaggtggtaactaacactaggaaaaagacccagtcccttaagctgaggggtagacagctggatgctttgtttcttaagctggatgcataacacaacagatggctggcgggcctgcggtggaggctagaggtatggtgcagaagagagctaactttctgacccattgaaaacaatgcatcacaggaaccaggggaaaacccttggcgtggctcacccactaacactgcatccaggacttgatctttttggatgacatcacaagccatctactttattgcctcatataaatggaatcgttcagtatttgtctttctgtgattcacctgtttcacttagcgtaatgtcctcaagattcacctctgttgtagcatgtgtcagaaatccattcctttttaaggctgaataacattccattgtacgtatataccacattttgcttatccattcacccctggaaggatacctgggttgctctaccttttggctattgtgaataatgctgctatgaacatggatatacaaatatctcttcaagaccctgctttcaattctgctttcaatatatacagcgtgggactgctggatcatacagtaattccagtttaattttttgagaaatcaccataatgttttccatagtcaccaaaccattttacattcctaccaacagagaacaagaattccaatttctctacaccctcaccaacacttactatttttttttatagtagccatcctaatgggtgtgcagtagcattttgaaacccacccaatagtcccatagacagttctttttggataaacaaagaaattgacccttctgctgttaaagtttgaaacttgcatctgttttgagtttcttccccagaaaaggaccttcaggcctttcaaaaaaagtatcaaagaaccaaaactcagctgatcaccagaccagatgactccttgcccctccctagttcttgttttcttacacattgttacatttcttccctgctatataaacccctagttttagtgggttagggagatgaatttgaggctgagctcccatctcagcagcagcagccgattaaagccttcttccttggcaatacttgtcgtgacagtgatgggctttctgtgcagtgaacaggaggacctagacaaaacccctggtgttttggtagcaatttcattgtgagtagtcatgctgagcgcctaagttttcatgtgcttattggccatccatatattgtctttggagaaatgtctatttaaagttatttgcctatttttaatttgcgtcttgagttgtttcatttgttgagttacaggagttctttatatattctggatattaatcctttatcagatatagacttgcaaatattttctcccatcccatgggttgccttttcactctgttgatagtgcctgatgcataaaagtctttaattttggtccaatttacctcttttttctcttgttgcctgtgttactggtgtcatatccaagaaattattgccaaatccaatgttataaagctttttctttatgctttcttctaagagttgtatacttttagttcttatgctatggtctttgatcagttttgtgttaatttttgcatagggtataaagtattcctaacactatttcctgaaagggacattcttaaatgattacacaaatacatgatttcattcactcattcccactgaaattttaacttttagaacatttgtttggcaagaaattatcccagtttgcagaaatctaagactgatggcctgaattatatatatttttacatgtgtgaaactgaaagtaaactgtcccctccacccctcaggcatacaaaattcatgatttcaaggtttataaaaatgatataatctgttcagtctgcctttctcaattactaatgatactatgagcaaagaactttacaaatggaagttacaatgcaatattggacaactaaacatgattgatatggaatctaagatttttacaaatatctccggaatagttaccccaaatggcaaaactttttatgccaacattcttttccagcttgaaagtacttaaatttatgaacacgcattttctataattaaactaaatgaaactcagtattcttgctggttaaggaagtcaaatagtgcagaaaaacatcccaatccaaaagatgagatgtgccaaaatcttggtgcaatcatagctcactgtagcatccacctcctaggctcaaatgatccttctgcctcagcctccctagttagcatgccatgcctggcatcagactgtaagctccaaatgtaaagaggagaactagaaaaaaattacttcagttcaccttttcttaattctgaatatcaaactccaatattaacttagagttaggggtaaaagtgaagatagcgtatcctatttctgtcagttgactattttacaccaggcttgcttcattagattagatgatataatctgctagttcccttaggcatctgaattcaggattcctaaagtgccagttctttttttttattattattattattatactttaagttttagggtacatgtgcacattgtgcaggttagttacatatgtatgtatacatgtgccatgctggtgtgctgcacccactaactcgtcatctagcattaggtatatctcccactgctatccctcccccctccccccaccacaccacagtccccagagtgtgattgttccccttcctgtgtccacgtggtctcattgttcaattcccacctatgagtgagaatatgcggtgtttggttttttgttcttgggatagtttactgagaatgacgatttccaatttcatccatgtccctaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcccatttctccacatcctctccagcacctgttgtttcctgactttttaatgatcgccattctaactggtgtaagatggtatctcattgtggttctgatttgcatttctctgacggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggaatgacttggcaatgcgggctcttttttggttccatatgaactttaaagtagtttctcccaattctgtaaagaaaggcattggtagcttgatggggatggcattgaatctgtaaattaccttgggcagtatggccattttcacgatattgattcttcctacccatgagcatggaatgttcttccatttgtttgtgtcctcgtttatttccttgagcagcggtttgtagttctccttgaagaggtcgttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagcttttagcatgaagcattgttgaattttgtcaaaggccttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggatttggtttgccagtattttattgaggatttttgcatccatgttcatcaaggatattggtctaaaattctcttttttggttgtgtgtctgcccggctttggtatcagaatgatgctggcctcagaaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcacatcctgttattggtctattcagagattcaacttcttcgtggtttagtcttggaagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttcaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatatctgccttcatttcgttatgtacccagtagtcatttaggagcaggttgttcagtttccatgtagttgagcagttttgagtgagattcttaatcctgagttctagtttgattgcactgtggtctgagagacagtttgttttaatttctgttattttacatttgctgaggagagctttacttccaagaatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggcttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttggttgatgcagtttcttcctagtctcgatggtctttacattttggcatgattttgcaagcggctggtaccagttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagattcgctgttaagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttcttttttctctaaactttccttctcgcttcatttcattcatttcatcttccattgctgataccttttcttccagttgatcgcagcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatctgatcgtctgaagccttcttctctcagctcgtcaaagtcattctccgtccagctttgttccgttgctggtgaggagctgcgttcctttggaggaggagaggcactctgatttttagagtttccagtttttctgttcagttttttccccatctttgtggttttatctacttttggtctttgatgatggtgatgtacagatgggtttttggtgtggatgtcctttctgtttgttagttttccttctaacagacaggaccctcagctgcaggtctgttggagaaccctgcagtgtgaggtatcagtgtgcccctgctggagggtgcctcccagttaggctgctcggggctcaggggtcacggacccacttgaggaggcagtctgcccgttctccgatctccagctgcctactgggagaaccactgctctcttcaaagctgtcagacagggacatttaagtctgcagaggttactgctgtctttttgtctgtgccctgcccccagaggtggagcctacagaggcacgcaggcctccttgagctgtggtgggctctacccagttcaagcttcccggctgctttgtttacctaagcaagcctgggcaatggtgggtgcccctcccccagcctcggtgctgccttgcagtttgatctcagactgctgtgctagcaatcagcgagactccatggggtaggaccctccgagccaggtgcgggatataatctcgtggtgcgccgttttttaagcccgtcggaaaagcgcagtattcgggtcgggtgggagtgacccgattttccaggtgccgtcggtcacccctttctttgattaggaaaggcaactccctgacctcttgcacttcccaagtgaggcaatgcctcgccctgcttcggctcacacacggtgcgcgcacccactgacctgcgcccactgtctggcactccctagtgagatgaacctggtaccacagatggaaatgcagaaatcacccgtcttctgcgtagctcaggctgggagctgtagaccggagctgttcctattcggtcatctaaagtgccacttctaaacagtcttggtgactgatgacattaagcagtggaattaaaaaaataggattgtccttggtgaaattataattgtttcagtctcacaagcagccctaatgcattcaaggtgacagaggtctacaaaactattcaaactcacactgtccatcccaacagcttccaatgcagagcctgactcctggtcaggatctgctctgaggctccctgggctggagctatatactcagggattacgacatcagcaagtaacacattcccaggacactcctgcagatactccatagtactacagagtatgaggagaaatgtgaagataagctgaaaattacaggatagctcacaaggcttccactaaaaaacaaagatctcacagcgaccacagttaataatagtatgtacttatatgattttgaatgttcttaccacacaaaaaaagataagttggtgaagtcgtggatatgttaattagcttgattgactctttctacaatgtttacatagatcaatacactatggccaggcatggtggtggctcacacctgtaatcccagcactttaggaggctggggcagggggatagcttgagcccaggagtttgagaccagcctggccaacgtaacaagactctgtctctaccacacatagagatacaaaatcagccaggcatcgcatgctgactacggaggctgaggcaggaggattatttgagcctaggaagtggatgctacagtgagctatgattatgccactgcagtccagcctgggtgacagagcgagatctgtctctaaaaatataaaaatgaaaacaaaattatcacattgtgccccataaatatacaattatttgtcagttaaaaataaattttaaaaaacaagtgcctcaaaccttcctaggggtagtaaatttatagcacttttccttccacagaaaagcaactataatatttctgccatttcaacaccccaccagccaaaggtactatgtgaagtttcgtgtacctacatgacgctatgtccagatcagcaagcagaaactgagttccaaagctgcattactatgctatgaagaaagaaagcgccttggccactgcccttccctttctaatgtgtgaatgcttagaatatacaaggggatttctaaggctttttgccttggctgtgtcaacttggaggttctgattcagtgagtatgaggtgaacctaaggttctgcatttctaataggctccaacattcagctgaagaggcagcagaatctactaacccactgctctaaaacaggaggtggagagataattctcttaaattaaagcaacagaatttacataaccaagtaagtaattgcaatcatcacctcacatgctgtctacttgttgtttaggaccattttggaattcctcctttaaaactaatttcacagatgacaacccattttttcactcattgaagcatcactatggagggaccctgttttggtacatggatacatccatgaacaaaacaaagcccctggcccctggcgttcaacactgtcatgggaagcctcgcaataaagaaagaaatacacacagagagtaagaaagcggggggagatggagtggggatgggcacagttaagacaggatggccagggaagggctctgagcaggtgacactggagctgaggcaggaggtagcaaggattcccacacaggtctggggaatgcatctccaggaggaacacgaagggcacaggttttgtgggaattgcaactgattcacttgtggagcacaaggaggtccagtgtggctgaagtgcacagcaggggcagatcctgtgggtcccatgggcccaaaaggacctggggtttactctgagggggacaagaagccactgaacatctgagagcatcttctgagaaacagtggtatgggactgtcattctctaatgaagatttgagcttgtcaacctaaataaaaaacagggagagggcctctaaaaggaatctgggaataaagcattgcaacaggaatgcgtatgccataaacaatgtgtatattcagggagataaaggaagacaaaggtttttagaggaaaaaatgaagattacgtaactgtttcaaaataattatccttggctacaaagatcaataacaagtaacgccagcctgaggctggacaggcagttgaacagacatccttgcagaagtgtcttctgtataaggttacaatggccttcatgtaaggttgtggtttttgcagagtgttttgtgatggttttagttatcaggcatacaagcataagaaccctcttttcatgggcttctcaattctatttgtcagggttatttttaacaccagtgattccattttgattcctcagagatttgagggagaattatggtcatgaactaagaagacgggggtaggcagatgtttgtactatttgtggtggagctccaacaagctcagagagagacttctaaacaagttccccaaatgatttgaatgttggccatgttttggctgctcaacatccactgcccccattaaaatcccggtcttgcttttggagacccctttggccacccctctctccactgtatcagccttggacagtagaggatccctgcaactgaagcccaagagccagagctgcctcctctgccctgacacagctggacaggcgtctacatcaggtctggcctgctggatgctgcttccaggactgacagtctgaatgggcaacctcatggcatggagatttgccaagctcacaaagagcacagggcagtgacgtgcagacctgccatggtatagactgtctagttctggggctcctgggttccagtttgtgctctaagcttcaatctctatccatctattgatttcaggagacttacaataaatttccttttcatttagggtagccagagtcaatttctattgcttactctccaaaaagacgaatcatacaataatagagctattagttttctttctctttaaaaaagtcagatgaaactgaatgggagtttatccgttttactttttccaaataaagcttatttaagttcaataaataatttattgattaacctaacaagtgccaggcactgtcctaggtgctgaacccacagtgctgagtaagatagaccattccttaccattctgcagaaggagagcaaagacaaatggcaagaagcaatgggccagagagaagagactgtgaggagtgttacacagagaatttcaggcagggaagagagttctgagacagcacactagatgactaatttagattgggtggttggagaaggcctgcttgataaaggtgaggccaatgtctgaaatataaccagacatccaaatgaagatcaggaagaacacccagtgatgagctcagctggtacaaagatgtaaagatgaggcagagtatggcccattgaaggagaccactgtggctcataggaaaggatgtgaggaggagcaggacaggagcttgggtaagcggagtagaagtttacattttaccctaggcaaagtgacacaaaggcactggaggattttgagcagcaagtgacataatttgatctgcactttaaaaagatcatttgtaagattgggggagaagagatgataggggcaaaatcagaacagggtgcccagtaggcagctactgctgtcacccaagtacaacaggatggcagcttggaccgagacagcgcaaggtagggagagagatgtggaggacttggaataagtgttgtctgaaatgctagttaaatggatgctgggagaaaggaaaatcaatctaatggctagatttttagcctgagtgtgtgagtgtccgatattatgaacactgacaagaatggaggagggggaagctgtgctctggccaaggtaagtataatgtatcttttacacataagagtggagcagtcatgtgtgagactggacacagagaataaggtttaccaatgattagtatcatacaggtagcattcaaaaccaaggtcctgaataagatcacttagggagactgtttagacaaatgtcagcaagacctggacaggtgctcactgaggctgttcagctgctcaggtgcagccaaccacattttataagtcacctgttcctgttctaccactattcaccctacccttccttcaataaagctatgtctgcaggggtcttctaggaaagatattcttcactgaaataaagacattcaggaatacacaggtcttcttccaggatgctgtcacctctaaatgtgatacttagagctatggcagccaccttgtgaccatgatggaaggtggcaagggcaaagtctccaaactgaagatggcacagcagaaagacagcactaggctgctgaccttatcaatcctgaagacgccttactctgtgactgcttgtgatgctacagagtattttcttattgtttaagccagctgaaatagggtttcctgtaatttgtaccaagaacatcaggaagtacagatggatggaggaaagagatttgaacatgcatttcagaaagtggaaaagcaaacatactagggaagtatggcagtgttgctgggcaaaattaactacacacttgagatgtgtgatcaggagatgagttagcatgattattttttccatccctagcaatttctagctaactggtggcaggggttggggggatcggggtgggggtctggaactttgccagacaagtacaagaagagaggagagagctcagtaataccaaccgttgacattactgagcagatactacataacactacgtaaatcctcccaagtactccaagagtattcactcatttaatccttacaattcccctatgaggttagtgggaaggtagctaaggtcatttgtaagaaagtgattatcacaaagaaccatgaaatctaggctgtgtgaggagagaagagaggaaaagagggaaatgattgagagtgagtggccccagacctgaggacttagtgaggtctgaacagaactggaaggttaggatgctgcagagtgagaggcaggaaatcgagattcagaacagagcaggtgtgcataactggaggttgtggggtgactgggctgaatgggaaggaggaagagatccctgcaggtgcagtcacagactgctaaaattcagctcatggacagtatgagacaatgtatagataatgctcatcatggtttctggaataaattttctgtgttttaaaagccactgaaaagcaaatatttgaatactgagaacccatcatttttaaataggaaaaatagtaatttattcttagcccacccaaaagctccaatcaatttccccacaaatcgataaaatggcaggaaaaaaaaccccataaactgctatgtaacagtctaccacaatttctacataatatttagcattttaaacaccaattacctacttattgaattcttaatgaattatttaggggatacgtgtatgtgcagaaaatgaatctatcagctacagattatgtttcctcctatgtggcattaaacagataatgtgatgaaaataaacaataagctatgttataggtaaaagatgaatgccaataatgcttagcaaaattaacaaagaatttcaaaactgtttacttatcaaatgaaaagtctggtggtacaggagggagagagagaggcaagagtcactgctgctccctggtgatgcggtaaagctgtgtgccggggcaggagtgagaactgttcacactcaaatgaatttctttcgttggtactcaagatcctgggagtgaatggctttgactcactgtctgaagccacagacaaagtaagaggataaaaacactcaaaatggatatctttgtttcttttgcttgtgatctgtaaataatattaaaatgagtttctagtttataagcggttgactcttttcatttattcactagttttcaaaattacaaggtggttccctagtatcctctaacgctgaacagttaagtttttaatctttggaaatcataattaacttatagattttagcctatttgatgtatgacaacccactgcagttaaaatctttattgatgctcaaactaccccatctttgaccagtgaggacttagttagattggctgtgaagtccttttgacatgaccaaaatagtcatcaataacttcctgttacctggtatcacaaaatgttccaagctcatcttgtacctttcctcctcagaccttgattccttttagtggagctacatttttaaatgtaacgcttttgctcacatcatgatcaagtttatttacaatagcaatgatttcatatggtatgttctgaattcttttaaagattttgcattgagattcaaagcttctcttttctaacaaatgacgagcactgaggatgagcattaccaagggagtatggggaatgagttttttgctagtcagtacttcactacatgggctactggattgccaacattttcagtgtccgttttatactaattttattgctttgatttaaccactttcttgaaagcttaaaagtcagaaacaaaattttgggaccagttttttcagggttgcataaatatcacaaatgaccactgttagaaaccaggttccctcaatgtttctcatttgtcattctcaggctgcatcttctgtcctttcagattatctcatggtccaaaaaggctgctgaagccttgcaatcaggtctgcaaaccaaatagcaggaagggaaaagggggaatgggaagggagtgctccattttcaaagccactgactaagtactggacaacagtatctgtttgcatctcactgcctagaacttggccatgtgtagctggaggaggctgggaaatgtagtttccttgctgagtgttttgccatagcatagagaataaaactgggactctctcactaagggaaaatgaaaatgggtaggcaattagcagacactaccacaagtggcaaaactgttttcatcatgcaacaaaatgtcttcatgttcatgtatcacttggatagaataaagatatacttgaaatgtaatattactgtttattatttttccttcatttaatctttttgagaagacatcaagaatttttctccctaggtaataatctcctgcgattatactacttaaaacacaacttactttgaggtagcaacctgtcttagcagaggcttaaagcacagcaagcttttgccagagaaggcaagaagtaaaatgtttaaaatatctggttatctcctgtattccctgctgcctcttgggagccatgagaaccttcaatgccatggggagatgttggcagcaatctgagactactctcccctttcctccaagaccaaaagacctaaattcaaagtacagaataatgtgaaatatagatgttacttccccctttttatatttacatgtattaaaataatctaaagcaagctttgacatttcacattcaattacaatgtaatgtgtaaagaactgaccataccttatgactttggattataaagtatgttttagtaacatttaacggtggaaaacccaagctttttgttctgttttttttttttatccttcatcttttcccttctcaagagagcacaaagaaagaagtcatactgataaagggggatgctcataacaaatcttccaagttaaaagtatgtggataccaaattgagggcatttactgatatgcttagaagtgatctctgacttctgatagtaaataccacttttgaattacttataaatcttctctcataaatagaaaagccccacttcaggttgttttttccttgaaccatgggaggaaacactgcagtataatgctaactttggattataaagcccactgcaagctgattcctgtgggactctgtgtcagatggcctaggcaagagctttcttcatgcatcagggcttgatgcttacaaaactaacttcctctcactttacaatgaaagcatcagggttaaagaggagtgagctatgtgaacaaacatggcatgtttactagtcttaaattgtgtcacaatcatacaaaaaccataaaaatatttatccttccatttgtgaccaatgtttaaagtgttgtaatgcttcctattcactgaggcctgttgtaaagcaatgaaaacacacacgcacacacacacatgcacacacgcacgcacaagacagagggctatgtaaggagaaaaacctaactggctcaaccccagcagaacctgcctgaagcatattagtttgagctctttgtggattatggtagagaagcctttagcaatcaggactggaatggggaaggaaggctggacagcaaaaacgtttttccagagcaaattaagcaaactggccacaattaaacacttttgtgatacagctttcattaatatttattatagaaagctttttcaactattatgccacacactgttagagaaacatacacacccaagtcttaatcattaaaaacaaaattacgcttatttttcaatgtttacatgcacctttaaaaacaaatatttgctgatacattgtgatatctttttaaaaaaaattttgaagatgtattgttacctaccagaggaacacaaaatcttcctttcaaaatcttttatttaaagactgccatggtgtgcatctgtccattcttggccagctcccaccaatagcactgtgcacccctccgcctttgagtgctgtcttgaggctgtgaactcagatgcttgccctggtggctctgagaggtctctggaggcttctcctgcccaaccctcactcacacccatatgaccaagacgtgagcacatgactcaagtcagaccaatcaactctctctccttcagcgtggatcttgaacagagcaatggaaggaatggctgggctagtaaattggagtgaaggcctccaggtaaggctatctggagctgtacttccagggagaagtttctgtgatggtggaaagggtttgtgtttgcactatgtaatacagaagtcactagccacatgtggctactgaacacttgaaatgtgactagtatggctcaagttttaatttttagttcattctgatcaatttaaatttaaatcattgcatgtggttagtggctacaatactagatggcacaggtctagagtctcctgccactgagagagtctctgggggccctttagcctcccatgagctcccttttggtggtaacactggtttctgttcaaaaccaaagaaacttgacatgacctacagttcatttcaacatgcccaatgtcttagtcaatgatgcagctgagggagaaggtctacacaacatctctacagttcatggccagggtaggaggatgctgcacagcacaaagtgggaaaacagccagctgatgcctagcgataagtgcgttctgtggtctagacaacctgggtcacacaaaagtgacctaagaaggaagacattcagaatctaaatgataatcttacaatacagttgctcaacatacacaagagaagtggtatcggccagcctgatctaaactgagatcttcccaacagacttctgaacataacacctatcccaggtacatggaaactgtccagagaaacaaaactaatagaaagaggggatccaatggactcttctgtagcagcatacatgtatcagatcaattactagggctgcagtaagacatctacctacctacagtaaaaatatcatgccataacatgcctaaccaactatgtcttacatgtgttgcactttttcattctaatccctagttatttatatagacaatatgttatatattatatataagtatatgtgattgatttaaagtcatattagtatctacaaatgtattataaggattatggctaggctggatattttttcctttttgagattttgtgttaggttttcctttattaggttttgtggtaagtacataatatgtattatgtatgtgtaatacatatatacttgtgtcaaatgaacatgaatacataagccagccctaaagaaaagtcttgattacattattttaatgcagtaacatttgccagagatataatgtttcatgtttaccttactagacaaatcatgtaactactaaagcaaaatgtcaaacttaataccttgatatctacagattccaccccttaagagttgtatttaacattttatactttaaaaaaaaatcaaactctcttaaatggtgaaaacaaatcaactatgtaatatttcctagcccaactggacactgaatatggtaaagcataaaccatgtagtctgtttaagaaagaaactatgtcatcatgtctaatgatttaaataatagttatttattgtgcactacaagttactctaaaactcagtggtttaaaacaaacacttactctttgatagattctaaggggtcaggaatccaggaagagcttggctggctctcctgcttccaggctcccttccccacggctggcaggccttctcggtcctgcacacataagctacattgcagggctgcctcttgacaaggcattgccagggcgagtgagtcaaggaagccatagtctttttacaacctatctgagaggtgacgtcccattgcttctaagtcaacatggccagcctcactccacaggcagcattacactgtgtgaacaccaggcagtcaggttagaggctgcctaccatgaggacaaagattgatcaagcagcacacactgtaaggagcatcttttcttccactcatctttcttttaccaaaaaaccccagtatttttcaagacaacattcagagagtatttcccaaagttcaaaatcatccctcattctttccaaatcaaggaggaagtaaaaaagaatatgtgaaccacttatcttgaaaaaataatagaggaggaaaagtgtggagagaatactatggaaaacaatccttttggaaagctcaacacatgaaaaacacaccgtacttgccaaccacagtcagaagtgaaggaagtgacaccctcacatcaaccgtttttcttgtgtttctgaattaactgtaataactgtaacaataaagagtgaacactccatttcataaaaactgaactttcatgttttcattaaatgagggttctaataaaagacttaagatgtaagtgagaaatccttactaactgcatgttagaaacacaaaacatctggctaagtttaccaggtgttatcagatagtaaaatatcaggaataaaagaaataatatgtgaaaatatttcatgttacctagaaatgaccaaagaatggagtggacatgaagacaagaatgtttctgatattctttatcaaaagtagggcacatgatgaaaatttaaagattctgggcatagcaacaccattattaacaggtaaataactaccacgtattgagaacttactaggtactatgtaatggaatacattactcttataatgtttcaaagaatcctatgaggtcactatcataattatcttcatttgacaaatctgaaaactgaaggctcagagcagtaaggtggccaccagatccatatgcactagtaaatcagtggtggattagctatgtctcattctgcaagtcacctgcttttcctaacagtcagctacctaccactaacagagaccagaaacctgagacccatagctccttagctatctttgccagggctaagcctcagcgagacttaataagcatacgaatataactgggtaatcagaacaaaaggaaaaatgaattattacctatctcatctgttatcagaggcagtgacaatggcagaaagcttcaaaacaaaatcacacagcagtcagctccggttgggcaggtgttgctggagagaaatgaattacacggcaaggcccgtgtgatggaagggtgcacaacactctgcctcctcacttcgctgcagatcttcctcctcgctttctattctctgtgctggcccacctcaatcttatcttgcagtttttagggctagtgctacaagaaaaggcctgagacgtgaaagatgtggaactgaccacaaagcacagaacctgtgcagaggggcctgagccgatgtgtcatgtgtcccaccctgcaccttctggggtctcctgctggagatcagcccgggtggagcagcccacttttttttttctttgtaacctttaacagaaaacgagcagcaaaatgagcaaattaaaacaagcaggatatttgactataactaaagctataaaggtgaactagatagctttactcttcatcgggaaaatcatcaaacactctgtaaaaggacagcattagaagattttgttatttaacgaactagtcaacaactgtttcatattaagaaagtggaatgagccattcttcttagcatagcaaagaaactctaacttactggaaacaaattatattataaaacatatccaacatccagtcagtttttcaaaactctaagacatatctcaagaaaaacaaaacaaaaccaaacgatctttccctcccatcccaaacaaaagtaaaatcaaggcataccataaaacaactaaaatctctatctaaaccagcaagaaaaactacccacaacatataaaatgaatgtattcaccaacaactattgcttctttaggttcagttgggtaatttataaaaatcatccaatatttgtaaaaggttcactgtatagtattaatagaatatcagttaaaataacattggccaaagctgtcataataaaatgttgggggataacttcacaaaattggccacctgtagacttcctagttactgaatttgcacataaacttaatgtagtcagttatattaaactgaatataaacttaagctgcaagtttaataaacatgttttaacaaattttttagttttcatatttcaaaacattttaaggcacagctagaggtaagatacatttgaaattcatataaatgttgacactttttccttcccatccacatctcccaactagcttcctacaggcactgttaagtatgttggtaaggaaggtcagtgacttcctttcactccgcttaccagtgtcctgagggttctaaacccacaatggcaggttccagagggggcaatccctgtcctgtatcctgttccaggagaatgtgtgaagggaagttctagacatgacgagtattaattactgctctcctagcaagaaccatcaaagtattgtcactgtacaaaatatggtttatggcaacaatggatttaccaaggtgcacctctgaaaaattatttgagatgcagaggttaaaggttaaaagtaagccatactgtcagtattttaaatgaaaaattctttaaacactgaaaacaaaatatgcattgattacaaatttaaaatgtatattgcagatttctctatttagctagctcacaactaattcctagacaccctctttgaactcaatcagagcaacaacaattagttgaataaccagagagggaagggatgagaggtggggaggaaaaaagcaacgagagaggaagtgacacagttgcatggcacaagcatgaagagcagggctgggagcacacacaagagatttcaagtgtgggcccagcaggtgggaactggaaccacggcccaccccaggagccccgtggggaagcatggcctaccccaggcacagagttggcaaatgggcagaactgtgaaaagtatgagactattacaccctcttcccatgagaagacaaaggggtgcaatggcagccaatgaaaagttttaaaatcagaacgctttttgagaaacaaggccccacttctcagcagggagtcccacagaagacagccattttggtttttatctgataagaggaaagctggagaaagaagaaaaatatcaaaatcacctaatcactaatcacccccaacaattaagcaagggttgagtaaaaagtaaagcaaaagtgaaaataaatgaaacaagatcagtgggaccaagatgactgagtaggaagtgcctgagtgagaagtctatgaagcatcaatgactggagctgacatctgctgatagaagcaaacgggtgccaagtgacttatgggcattatctcattcaatccttccacctaccccaggatgtagggactatcatcttcctccacacagatgagaaaacggaggcctaaggtagggcctggagccaggatgcaagcctggggagcctgctctggccctctcctcccctgtgttctagagggagtgcacctttgacccctgcgctgtccctaaaaacactcatggactgtgcccatccttcttgtctaaagctggcaagatgtgacggggatggggacaggagcagggcccataaacaccagagacctactgtcctaaaatgccagacccctgtcctgagctgggaaaccatattaagcaaagggtgtgtctcacaggaaacagatatgagcagattcggtggaggcagcctgggaaaagatatttacaaagctgaatcatggcctcccgccctgctgggtgattcctgcctcctctcctcccattctctcagacaaagaggaaaagcaaaagaaacaccacaacaattctgagccctcaaccagaatcaacccaaagctcactcgctgtgtaaaagaagaagaatactgacagaggttcatgctaaaaaaacaaacaaacaaaaaaccacgtggaagattaacaaaagacatggcatagttactggacaagacaggccagcctccccactcctcaaagcaaaccaaaccaaacaagccccctactgaggacagcaaaggcacacacatggcatcctaaagacaccgtcttttatttaagaaagcctaactaataactgaagaaaagttcccagaagtgcttactatgaaataatttagagatgacataaaatcaatatatgagactcaaagaggcgatggcaaatgaacacgctgaaatgaaaaacaagattgcagagcaactgaaacactgaggaccaaaataacataaatacagaactaataaatgaattagaaatagcatgctagaaggaataaggctaaagtcagaaatcacgccaaaggcaaaacacttgtttaaaggtggtatatgcacacaatgaagttagaagctaagcaaataaacgttaagagaataggcataaaggataaatgactatttaacaaggaaaactgctgtttctaaagcacaaaatccaagagttaggaatagaagacaagtctatggctgaaaagccacatgatgaggatggcaaaacagcaggctggaaagtctggtagtccccatcatgcctaagcagcggagccatgccagcagcggagccatgccagcaatgccttcccagacttcttataaaaagatacccaaggccttgttaagccacagtcagctgagtcttctgttacctgcctcctttccccgacaatccttcagcctactcacactcaattcccttccatacagcctcctcccactgctgcaacagctcagccacattctttgcagtgaagccttctttcctctctcactgcacatggctggcaaactctcctccgtacactgcatcacccttttaaccttttctgagtctacatccggacagagaaacactgctgcagagacccatcaacttcaaccgatagtgctactctgcaagagggtaaggggggcagctaactctcactccccataaaggtggttgccacagcaccattccccttccctgcctcgcccctcagtcagtcacactcttatgcagatcatctctcctgtctctcccactcccactggtccatttttctcactctcacagctgcacgcctacagtacctcaattcccagcctctccatctccttggatcacatcttgtcctgccccctccctcctccctgacacatggggctctggcacaaggaatctattctccaatttaaaacaaatcccattgtgtcctccagggccaaaatccttcagccaccaaactgttagtattctctctgaattagtgaccaataatgctagcattggtgaaagttcccagtgttctacatccttgccaacatttactagtctttaattttagtcattctataggtgttcagtattgtctcatcgtggttttaatttgtatttccctaaagactactgatgtagagcatctttttatgtgcatatttgccatacttacattttctttagtgaagtgtctgcttaaatatcttgaccatgttttaactaagttgctttgttttcttactattgagtttagagaattctctacaaattttggatacaagtcctttatcaaaaatatgatttacacatatcttcttctattctggagctcgtacttccattctcttaacagtgtcctgacaaaagacattcttaacttcagtaagtccagtatttctatttttttctcatgtggatcatgttcttggtgtctcatctaagaaaccttagatttctaacccaaaatgagaaagatatttttccctgaactttgttctaagcacttctgtttttaggttttacattttaagtctgtgatccatttttatcaatttttacatattgtgagaactatggattgaagttcattcttttgcatacggacaaccaatagttgaaaagcctgttctttccttgattaactgcctttgcatgaggctttatttttcaatgttcaactctgtattatgtgttatttttgtctctaaggagtctaccaaaaacatctcaagataaaggacataactttttcctaaaaatgcctacaactattagaaatataaggaagaaaaatatgggcataagttcctaacaatattggattttagacaaagaaagcacaacctaaaaggagtgatacaaaggaagcctgtgggaagcgggagtgcccccaggggtagtgggaatatggtctagattacatatatgagctctggggtgggacacggaaatttaaataactagtacgtaaatcttaagcttataataccagtttttgtcctcactgtttcatatcaaaatgcacttatatatgtacagtaagtcctcacataacattgttggttcctggaaactgggacttcaagcgaaacaacatgtaacaaaaccatttcccctcacaacaacattataaaggaacaaggatgaacaaaaggatgtgatttcaggagccgctgtacatcattttgtttaaagttgcagtttccaagaaccaatgatgatgttaagcgaggacttactgttattattagcaggctagcacaatggcatttttggctcacggtcaacactgtgatactgtgactaggcttctatgtttgcagtggatacctccatgtaaattatgaaaaacagaaatgagtaaagaatacaacatttctgggccaggcacggtggcttacacctgtaatgccagcactctgggaggccaaggtgggcagatcacttgagcccaggagttcgagacaagcctaggaaacatggcacaaccctgtctccacaaaaaatacaaaaattagccaggcctggtgatgcacacttgtagtcccagctacttggggggctaaggtggggggatcacctgagcctgggagattgaggctgcagtgagccatgattgcaccactgcactcttgcctgggcgacagagaacctgtctcaaaaaaaaaaaaaaaaaaaaaaaaaaaaaaagaacacaatatttctgaacactgacctggagttctgtaagagggggtttggggaacactggacccacatggctctgtgacataccaaagaaacaatatctcacacatcatcttataaagccctcttttcctgtaacctcacccttgtggctattctttgagctaattacacaaaagttgtttgttcggtagtttttttttggtaacaccgacataagatcagcaatataagagatactttcaaagcatacttaatactcaaatatcttctgtacctttgctcatgactatgaatacagcaggtaaaagtacacttaaagaccatgttcaaaaaggtattcatcaactactgtttgtgttcattttaaacaaaaaggctttgcaattgtttttaaatcaggggttctggccgggtgcagtggctcacacctataatcccagtacttgcagaagctgaggcaggcagatcacaaggtcaagagatcaagaccatccttgccaacatggtgaaaccccatctctactacaaatacaaaaaaattagctgggcacggtggtgcgtgcctgtagtcccagctattcaggaggctgaggcaggagaattgcttgaacctgggaggtggaggctgcagtgagctgagatagtgcccctgcactccagcctggagacagagtgagactccgtctcaagaaaaaaaaaaaaaatcaggggttccagttgtattctccactaaattcttcttttagaaagaaggaaaaaaaatgaaaaacttaaaaaattgtctccaggcagaaggacagaggagctgtcaagaacctggcctccacctgccagggcgagcctggagtcccggaggtctgagaccgcacctgctgcccagcacatggcagccctcccagtgcacacccacctcacccactcctcacgactcacccatcccagcttgccatggtgtgcaagtttttctcactcctctgaaaaattctcttgataccacactcataccaaagcattctgtaaagggccctaaaggccactgtatcactcagcaaacacagtgtctatttattacattttcttgttcactgcatgtcctgactgaggatcagttacagcaggagaacttgccccttgccttttccacacacggagacaggtgagtctcttatattcccagggagctgccagatgtgtgacctattagcttaagcagtatttttgctagtatgtgattctaaatcactacagagtattttttgccactgctacatatttgcagcaactatgtaatctgcatacccgtattttattgctcaggcaactaaaaccctaagaaaatgttgaggacatactcattatgttttcttctctctggagtacagcacccatcatttaaagctcagtaaacagaaacttctagtttccaatatttaatgaatcactgatgtcctccgtcttttgacggcagagagtcgccctcaagacaagcctctgtcagactgcggatgaccaagtgtgagctccctgtttccttcaacttagagagggatacagatttctgctctagaggacttctaatattacacatcagcacatcccctgggtgttgtaaaggcaagtaagtatttgataaagagaagaaaccactcgtgggtggagtggcagcttccttcagcacatgggtgagctgtgagcccaccacacacggctgcagcagaagagatagggcaccagcctagggtccagaccaggggttaccgacgtaccacaaagatgcattttacctttgggaatcttatttctatcacctcctaggtaaggtagacaggatgggcttgccattatgaacattccgggaggtcgccatgtcctctccttgccagtcccctctaggtgcagcagcagtgctccaacatttggagtgcaatgacatggttgaggtgctgagctcttatcaagacatgaaaatgagctcttctctcctaagctgaaactaatctttctccagtaaagaagtttcacctcctctcacaggtctttctataatgcagaggctgccaaggtgaaatttatgcctttgctgtgtgttttcagagtgtgaatactcataggagatttactcatgatgggtctttactatttacaaagtagctggatttctgagaggagtcactggagaatggtaaatacaagtcaatcactggctgatcatgtattcattataaaagccagaagctgtggtttccattgatataagctcccaaagagcctgtaaaagaaaaagggaaagggagccaaatgtcgagtgaatgccaggatagagtaaactttccatttactcctgctgctcctgagcattctctttcattccctcataacccaacagccctcatctattctagcaactcttcggataaattcttatactgatcaagcaaagaataattcacgctgcccctttaagtgctgtgattatgtaattataatgtggtaaggggttgataaatatttcctgcattccagtaccttcaaaggcctccttactgttaaacggttcaagtctaactgagctccagatgctgttgacaaaatctatcaatcttcggtcaacctttttattttttttaatctctttttacttttcaggattttcttttttttgagacggagtcttgctctgttgcccaggctggagtgcagtggcacgatctcggctcactgcaacctccacctccccggttcaagtgattcttctgcctccgcctcctcagtagctgggactacaggagcccgccaccatgcccagctaattttcgtattttttgtagagacagggtttcaccatcttggccaggatggtctagatctcctgacctcgtgatctgcctgcctcggcctcccaaagtgctgggaatacggacttgagccaccgcagccggccgaatttttttttttaggaaaaaagtagtaggcatttaaaaacaaaacttgtacatatggtcaaggaagagctacacgttagtatgatgccttggaaaaaaagcataaaacagcagcaggtgacacatatctagttcttattatgtgccaggccctgtcctaagaactttatcaacttttaattttcacataaattctctgaggtggtgccatcaccctcattttgcagaacccccaagaggctgtcattggcagtgtgaccacatccatcactacgctacctctctctcatgacaacaaagactgtgtgtggccatcttcactgactcccaaccccacccagctagagtagcataaagggcaggatggcacctggattaccaaagaggcaagatattagaaatagacagcaaaagaatacttgaagtgcaacactactaaggtatcagtggatgtggatataatacatattttgactacattagaataaaagctatcataaaagccttaaggcaaagaaacaaagccagtagcattgaccttttgacatggaggtaccaaaacaatcttttaatttttacatttttactactggaccataatcacatatgatatagctgtatatgtaatgagaatacgcaaactttttgcttctgtagtagttgttaataccagtgatttttttggttgtctttttctatacatccaacatatggtttaaaatttttgaaagtatgctagggtccattactcttcagagaataattcatcatacaatttcttaaacaaagccctttcactatttgaaatgattaagtttaccaagattctacaataatctttcataaatacagaatgaaaagtaagctcgtacctaataaacattgcaacctcggactacatgacaaattacttctttctcaagggaaatttgaaaaaattaatttactagttaccattctaatgtttaatagatgcacagattagggctttctacatggtataatgtaaagtgagcaactaactagaactctggaaatttatcagatactctgatttgagagattcatatttatcagaaaatcatgacttacagcctaaaaactaaacttgtaaataatatttttgttatgatgttaaatttataaacacatcccaccaaactctgtgaaagcagaaaataaattatggggtataataaaacacccaagaagaggtaaacctacagtattatttcatgggcctaaggctgtatgtactgcatgctcatcacagtaaacctcctagcccagaacaaacacctttctatttacattgaaccaaattttttgtcaagtgtaatgaggagctgactttcacgggtttgtggctcttctctgatcccttatcttggtatctagagagctaaggactgcagtcatcaggagccttgcaagctgctcactgaagcagtttctgtacccccttgtggggctccatgtgaattaacactcagcacctcctttcagattagtctatcaaggttatctaaatatatcactatgtggtggataatctttgtatactttaaagtgttaatacaagtaattcttctgcatacaaaattgtattttaatggtatgaaataaagcacaatttaaggagacaagctataaatatgttgtgaaaaaattaacgttaagtcaaataaataagctaagtacagagtgaaaataattacatttccaactaattacatttccaactaattacgatggaaataaaactaatgtcctttctggcatacttaaagattgatccataaacaaattcacagaaagaacgttaataaagtaaatctgaattgtcttcagtgcacaggcctctcccggaaagcagacacaggaagactgcacatctgtgaagaatatctctggatggtgtgcacaaacttactggttgacttgaatttcccagattttataacttggggctaaaataaaggtaatgtaagaggattaaacaaagcactatgggaggaagctgcggaaagtcttccctgagcaggggcactgggaacaagaaggcctctcccaacaacagcaggggcctcaaatggctgagacggggtgcagacaggatgggaagggcaaaactgagcaatgaaaataaagtgttcaatgccaggatgagcttatgctttctttagtaagcaatgtgaaccactggttttgatgtaaagttcatttagcaatcatggatataaatgtatggaggatagaattccagagtttaactgtaagatgctggattagctctgagggcaggtaacagaagactaaattaaaagtgtgatagtagaaacaaaaacgaattctaaacataagagatgggtaatctaaaatagcaagctgtccatatctcttcagttaataaaacatgtcaagaactgcctatattggcaaccattcgtatgacatcaatgcaacaatatgtttacactgaacatcattttcctaatatcacagcacatctcttaactaacaaaaatcctaaatggcagaatgggacaatcaatatatccttaattacctatgtgaccttggaaaaggttctaagactcagtttccatatttttgatatgggagtaacctaccttttagacttgacataaaactaagagacaatggaataattcctaccccaggacctggtatacagcataaactcaaaggaaaactgaatctggaatttatagcctggaattgaaaacatttcaaactgtcataccaaagttggaataaagtgtaaggttagatttataaaagggtttatatatttaaaaagttctcatctcggccagaggtttggaattgtagacttctaataatcttataaagtcactaaacactagtatgtatatattagtatcagagcaaactagttaaatgttggcatgatattaaccctcagatgagtaaatatagtcacagttaaacccagcataagaaaagaagtttcatgttcaaaaactctaagagcgatcatccatacactgactgtatcttttgttaagatttttaaaaattgtaatgctttcatgttatatcgtcccgaaggagtggtttctgttacagtatcatgaaatatagtgacatcaagtatttcatctagttctactgtttacgtgcttttgctgtccaagtgtgtaatgtgagtgatggcagcactacaaaagaatgtagtttttaaaagaaaaagctttgcccagctgcttgtaataaaataaccaaacctcacagcaagggctgattaagataaagataaatatagtaacagatgcataagtctgaaatagatctgagagaaactgttacagaaggatatttccatgactgtcctgataagcaatttttagtgattaaatatgcctgggcatatatatctattttttcatataaaagctatttatactgcctccttacaagttagtagtcataaaataatttttattttcaactatcaagtgctaacttggtacacagcaaagtgatcatttagaaatgacatttattatttataatcaaaagtataatgtgaattaacttggaaactgtcatcttttttctctttttcattttcaaaaagcaagctagttgctcatgaattgaggctctataagttacgcagctctattttaaaaatacataagctctaagttctggcattttatcttccattttataggaattaaatataattaaatttaaataatgtcatgtaaacattttatttcagttatatcttatcttagaaacaacaaagattgatcatttgtaatatatggaagtacttgaaattgcttttggctactccattaaatcagttagtgaggcttatactgtaaaacaaatatgcttctacccagactgtagcaattaagcttatgatttatttagtggcataaaataacacttcatgaaatctgtcctaaaataacatttgttaataaaaccattaacaagattattctgaaatatgacatcttgtaatgagacaggaagtgggactgacctgctacccacaatctggagactgagatccaacctgagggcaaagactatcgagaaccccagattctaaagacagcaacaaacctgagcctgccctcctttggtgctcatgaagagcacctggcatggcaccagcacagctactggcatcaccacccagacacttccttccagctatgcattacggacacggagaagggagaggaggaaagtcactgtagtcttaacaaggagggctgggattttgcctctgcttgctccttccccaccttgggggtaggagggtgtctaagaggtcaaggagactgaggtgcctccaagaacaggagaccagcactgcagtgacagctgtccctgtgctcaagcggcagacttactgcacagcccctccttctactgaaccaatgaaaagaaaagtgagggagtgggtagggaggagaacactggtggcaacctgcatacctactctctggtgtggtgaggataggagagtctctcctcaacatcatggaaggtacctgggctgcagctaccttgccagacccttacacagagagacagcctatgaggcaaagacatgagttacgattattcagcggacaaaaataacataggcttaaaaaacatcaaagcttctctctccttttaaaatatcccaaacttgtaggtattcttgggttatctctcgtgttgttctgccacccgctgggtgttgctcttgtctctgaggttgatgagaatgttctccagttcacattgcagccatctatgtgggcagaaactttgccataaggccatctccaagctatatgggaggctaaaatggttatgtagagctaaaatggttacgttgatctagctggatctgaaccagggtagcagtattattactaaaaggaagaaagatccagccattatttggaaacagctagtagtctctgccacagagactactagagactctgccacagagactactgggcactgccagagacgagtggcagtgcaagatggggatctgtagtcagacctcctacctcagggagcggtggcaccaacagaaaccataggagagccagcaatggacacatgccacccagagaacaggagcagcagcagtgcgaggagcctcttgatccagcctcctcccaccccaacagagagaaggaatcaagatctagaatggggtgaagggggtcctggagaggactgccactcccttgaaagtggaggagaataacaaacagatcacagccccttgccaccaatgggtccctcatcatatatgtatgtgcaggtctatttctggaatttctattttgttccatggctctgttatgtctgttctcacactagtatcctggtgtcttgatttctgtacctttatagtaagtcttgaaatcaggtagtgtttaatctaccaactttgctctttgcatttccatcaaaattttagaaccaccttgccattgtacacaaaaatcgctgtaagtatattatccaggattgcactgcatctacagattagttcaaagagaaaggacatcttcaaaatacttcatcttctgatccacgaacacattatgtctccatttaagtcttctttcatttttgctcagtcatgtttggtagttttgagtctacagatcttgcaaatattgtgttaaatttaaagtatttcatggtttttaatgctattgtaaattttagtgatttttaaaaatttactttgcaatggtcattgctagtacatagaaccacaattcattttatattttgaacttgtatccaatgaccctgcttaattcacttattagttccaaaagtgttttggtagactctttaaaattttatctgaacatatcatgacatgtgtgaagacagtgtttaaattcttctttccattctgtatttttcttttttctttttgagatggagtttcactcttatactcttgtagcccaggatggagtgcaatcgtgtgatctcggctcactgcaaacctccacctcctgggttaagggattctcctgccccaacctcccaagtagctgggactacaggcatgcaccaccacacctggctaatttttgtattttgttagagatggggtttcaccatgttggtcaggctggtctcaaactcctgacttcaggtgatccacccgccatggcctcccaaagtgctgagattacaggtgtgggccaccgtgcccagcctctgtatgtcttttatttcttttgctcacttattgcactggcaaaaacctatgggacaatgttggataagagtgacgagagtggacaggcttgtttacttccccttttagcagaaaagcatatagtttttcatcactaaatatgctaactgtaaatgttttgtaaaggccttctgtcagtttgaggaagtatccttttgtttctattttatgaaatttttaagaaatcatgagtcaatattaaattctgtccaatgctttttctgtgaacattgagatgaccacacaattcttgtttctgttaaaattgtgaattgtattgatttataaatgagataaatcctgcttggttatgatgtattatctttttatgaattattggatttgatatgctaaaattttgttaggacttttacacctgttttcatgagggatgcttgtctgtatatatctttcattaactatttttgtatttggtaggaaggtaatgctggcctggcctcaaaccatgagtctggaagtatgctctctattttctgaaacagttggagtagaaatgataatatttcttccttaaatggctgactgaactcactagtgaagctatctgctcagagctttctttgtggaaaaattcttaattacaaattcaatttcttaaaaaagtacagaagtattcagattccctattctcatgtcatgttttggtaattgtgtcttgcaagttggtgaatttgctcctataatgtttctcataatattctctttctactgtttaaatgtcgtaggatttgtagtggtgaatgatctttcaatcctgattttggtcatttgtgtcctgtctccctctgacctcacctctgacctaccacctttcatttccttgatcaggttggctttttttttttaaacattttcaaagaatcagctttggttttactgattgttctctatttgtgcataacctatttcactagtttcctcttttaaggtaaaagtttagatcactgattctagaccttttttcctaagattttaaagttataatttccttcaagcattgttttatctacatcccacaaaatttaatgttttcattttcactaaattcaaaaatacattcaaattgctcttgtgatttcttacttgacccacagactacttagaagtatattcttttattttccaattatctggagattttaaatatgtctttcggttttttatttctaatttaattccactggtgtcagagaatatattcttatgtcagttttttaaatttgaggtttcatggtccatcattttattctgataaatattccacgtgcattttgaacgtgaattctgttcttctgttgagttctccgaaaatgttaggtcaaattgtttcctaatacacctaaagttttctatattctcactgattttctttttacttgctctatcaattatgtaatctccaaccaaaacagttgatttatttatttttccttttatttctggaaattttcattctatgtatattgaagttctattgttatgaaacatcccttctttatcttaggtaatatttcttgtcttgaagcctagtttgtctggtgttaacatagctgctccagctttcttttctattgttagcatggcatatctccttctatccttttagttttaaacctatactgtatgtttatggttaaagtgtgtcttttataaacagcatgccattgaatctactggtttaatctgacaatctcttccttctaactgtattgtatacaaaatttacatttaatgtaactatccacatgagtttaaacttaccatcttgttgttttccatttttatcacctgttgttacttgctcttctttcttttcctgtcttctttggaatgagtgtttttagtattccattctatcctcactactggcttactagctgtatttctctccatttttagtggttgatcaacagtggcctttctcagctagggctttatgagagaatacagctaacaggaaataatatgaatactttaaaatatcccaatgatggtacatatacctcttagatgcacaggacagaagttaattcattatgtacaatagaagtcttgcagaagtaaaaattaattttcactcaatttggggaagttttggccattactttttaaaatattctttctttccccacttctactgttatatccactggaccacttgataatatgtatatacaatagacccaggtcactgaggctctgttcgttatagtttttaggtcttttttctttgtgtactctggtttccacggtgtctatttctgtgtcttcagattcactaaacttttcttctacagtacctaatctgctgttacttccaaaatttacaatttctgaagtaaataaatgcagcaaaattttcacttcagagattgtacattttacccctagacatctcaaatagttgttttatatcttccatttctcttattagtttttttcttttaaatccttgagtataaacgtagtcgtggctttgagatccttttctgccaattccatcatctctgtttctactgactgcttctgctcctgggtcgtattttcctgcttcatcatctctactacttttttattggttgctagatattatgtaattttgttctgtgctggattatgctgtatttcttcaaagcatattgaatgatgtaccaaaggcagttaaattctttgccaagcaggtggatccttttgggacttgtttctaagctttgttaagacaggcctagagaattctttattttaaggatagtatggccctaccaaagcataatccttctgggtttctactttcttcagggtgtcctacaaagcctctttaatctgctattcagaattttaaatgttcccagttcacttctgtgtgaactctgggaattagtctgcttacagttctctttctctggtagttcctttgtggctttgttgagttttatcaaatgaaagcacatcttggcaatcaccaaccaactcaaggtcaccctcgtgcaaatttctgttcttctgtgtagctacttcctatcctgtgttgtatctcacatattaatccacttcagcctcctcagaattcctaggttcctctttctttcactgtagtctggaaaatgcctctaggcagaaagcagcagtgattttaggacttcccttagtagattattttctctcaggatcacagaactgtgctacctgtaatccagtgtatgaaaacagctgttccatatatttgcccaattctctagtaatttaaagtagaaagacacatttggtctctgttactctgttactttctatttctctggaaatagaaaaagggtacttttgaattagacttgagaatgaagttttgaactgagccaaattaagcaggcacctttctcttgaataaccaaaaatgactagaaagttactgagtcagtcaacaacacataaaccaatgggaaaaaaagatttttaaaagttcagttgaaggcaataactagagaaaaataaaagcatttcatgtttatactccacttagttcatactgttcaacaaactgctttgttctttaaatattatttttgcaaaatgtcatcaagataaattcgagttaactaacatcattaaagagtagtttatacatccattactcgccaaccttaaatttacatcagttatgtttctgtaaaacccagtgtacctgagataattttgaattaaatctgctttctaatagaaatattttaatgtagtattgcattcctaatcatgaagaggttatctgaggatgacaggatcatctgcaagaggtaccaaagacctagaccagctattacggtcttccctcgcccctccaacacagctaatcagacagcattatttccactgaacatgaacatggccccaaacactgtgaccaggctgagccagcatatgagagtaaacttagccacttgtaccctatttcaataacagctattataaaacttaaaaagcagttgctatgagccaggcaccattctcaagcactttatacactccatttaatcctcacaaaactctatggcactgacacatccattacggtaacactaaagattagaaaacgaagtcccacaattggagtggggtgggggcgtggggtggggacaacattcatgcctaggtgatctagttcaaaactccgtaactactccatcaagggctggcaaactatggtcagtgaaccagctgcctgttttgtgaataagttgtttctgccaggatgaaaaaatcacagaactttcagatatagtcatatagtagaaatttgcttggggagggataaataggaattatcgatctcacttacaggccacaaaagttgcaagtggccatggcaacaggtatgtttcttgagtgttgcaggcacttttgttctgctgcagttactgcagtgttgctgtgttttaagatggtactccacatgttctccccaggtcactctactatgggttatctttagagtagaagcagaacagtgccaagaacgcaaactaggtctttgcttttgagtcaactgcaaatgaccaaatgtctatttgatgcttggaatacactgttggaaaggattctgaagccccatcctcacttctataccatggtttaccacaggatatgatttgtgtcatcaatgacttagtctaccagattcagggctgaatttcacacttattaaaagtgagctgtattcacttgtttctatatctatacaactaatagtaaaaaagcacaaatgttttcaggaaaaagtgttaggtttaataatgggaaaaataattgttcatgtgactttttgttgtcgttatccaaaataactcagttttaaaagccaagtgtgaagaaaaagttttcatattattttatttaaggctagtatcaaagagttcagacaattatttaaactaactctttaacaaaacttcattataggtctagattagtgaaacgccaaattaggaaatattttaagtgttttgttttctcaaaatatgtaaatgtagaataaatccaataacactagagaatttctgtttccacattccctccctataccatgacccattcctcagaataaattttctgactattcttgtatttcattcttctggtagtcatctctatatccctaaatagtaaacttgtatctaggtttctggatttaataattttacataatgtctactgattctcctaaatttaaaaattagaatttagctcatctacactaatcttcaactgcctctcccaatttttagctcttctactagttgtgattgtaagtatacagaatatgattacattctctgtttcaccaagtccaccatgtatatcaatttctcactgatactggagccacaacacacttttcctctgagcttccacaacccaccttaggtaagcttcacttttcctataacatcaagattataaccactatcaagactttatcacagactagctgtgttgaaaatcagtaatcagtatctgcaatattatatatacacacacatatatgtgttatatgtgtgtgtgtatatacacaatttaataccaggccaagaggtatactaaaattacatttcattctttacaaatctaatgtcataatctgaccactacaataaattttaaaaatctagttttaagattaaatggacccacttttcttgctgattgcttaaaagcctgaccttcccctacaaactgaggcatgagtggaggttctcctaggatttctaattgctttttttctgggagcataaggttgaagtggagatagatgttatccccaagttgtcaaccattgttttgcttcaagagtcttttgtactcctgttccaatttggaatggctgttttctggactattgtatagccattattacctcaaagacctgctttgactgtgcaattaggttggttcctctaattcctgaaggccaagtctctctttcttggttattactttgttttcctggagtacatactcaactatctttctgataaatgtatttgggaggctgggcatggtggctcacaactataatcccagcactttgggagcccacggcaggaagactgcttgagcccaggagtttgagactgagaacagcttggacaaaatagtgggatcctatctctaaaaagcaaaaagaggtatttgggaagctaacttttctaggccttgcacatctgaaaatgtcttaactttgctatcttatatctagacatatctttgctatctcatatatatctatatacacctcaggtacagaattctaggtttaaaagtgtatttacctttgggttttgtaggcaatgcttatagcatccatgttgctgatgaaacaactgatgccagcttaatacttcttcacacacaggcaacttgtttttcttcctctctgaaatcttttatgatcttctcttaatcctccgagcactgaaatttcacaaatacacacccacagtgactctttttcattaactgttctggctttcagtgggtctttttaatataaagatgtgtgtcttttccatctctgggaattatcttcctccactattttgataatttcctctcctctctttccttttctctagcttcattaagtcaaatgtcaaacctcagaggttaattccccacatatttgctcttgcatttttttttttttttggtctttgctctacattttagaaggttacttcaacttcattttctcacatttctacttaaattttcatttcagcaatcctttaaaaaaaacctaatagctcttttttgtaatatcattgtttctgtattagctgtttccttaaggctcagttgtttttctttcacactgtcaattctcctcatgtactccatgacctcttggttatgtgttctttaagatagtaacaccaggagagtgggaactgttctcctccactcgtgtcagttggcatattttgggggagggcctcctcccttaagggggaattctgaactctatttgccccaataggcaggctttacttgatatgaacagaaaacagtctgactatcgagcagtagactccacagaatgagaaggattttattgtgcaacatcaaaatccatatcatcaggagtcttagttttctgaatttcgtctcatgtctaaagaagtcagtttttctgaaaacttgcatatcttcagaaacctctttgcagtacatttaggctagggcttttcaacccgtctcatctgtaaaatcaatcccctcttcctaaagagttatatatctcatttgttgatgcctcctttcccgttttctttggtattcatgtttgtaattatacctttttttttctcttttatagtttatgttttcattttggtgaagccttaaaatgagaaggcagatgacaatgctcagtaactagtctgctttcttgacccagagccttaatgatttttaagcttataaaggaaagttacggccgggcacggtggctcatgcgtgtaatcccagcactttgggaggctgaggcgggtgaatcacaaggtcagaagtttgagaccagcctggccaacatggtgaaaagccgcctctactaaaaatacaaaaaattagctgggcgtggtggcagacgcctgtaatcccagctacttgggaggctgaggcaggagaatcgcttgaacctgggaggcagaggttgcagtgagccaagatcacgccactgcactccagcctgggtaacagtgtgagactccatctcaaaataaataaataaataaataaataaataaaaataaaaaataaaggaaagttacaatcacacacaaaagtagggtaaagaccacaatgaaaggtcatgtacttgatggccaaccttcaaaaatatctgtaagccaataacattggttaatttgtggcctctacaataataaaccctgagcaaagccctctataactggctcatatgggtaaggattacacaatatctagaaaccagttgataaaaatgagtgtcatataatttgattttgtaaccaggtcaagagttctttgcaatatctgctacacaggttcacagaataatggtccagaaaggtacaccaggcctcacagagtccagtactcttctttaacaagtaataaaaattcaagagttgggtgtgtatgcccctatgactggggcacataaaggaacaggctcaggcaatcttaatcacaggtaacttagaggtatgtatagttgaacataaacatatattttaagggttagatagcaaactttataaaaaattattaaactgacattttagacaaagtatgcccatgtgacagactgctagtgcactccgtgtgtgtatgttatattttggtgagaagtctgagaagcacaaagctactcaggagcaaaaccagatctccagtactataatccaggtctcttgattatcagtccagatggcagaaagggaagtgtcagcttagcctacagatgcatcattgaaacttagaactagcaatgcatgccctagaaaggtgccccagctactaatgtaaaaagccatgggataactaacatgtgtatggcactttccagtttacaaagcagtctttaaaaggtaacaaatataatgtctttaaaaaaaaactttgcaatacagatactatcatcaccttcattttacagagaaagaaaagatcagagacccaagtaccttgccataattagcagcctgtcacacaattagttaatggtttaaaccctgtctccttaactctaaacctttacaatgtaggatgaggcccatgtttttcattttcaccattcacctgctcccttcttacggtgtcttgctcttgtttaatggctctaacagccgagtaggttaactcaaggttttccaatgtatgtcttcagttgcctgcacttttattcctttgggccgcatctgcttgcccctcagagtcttccgcaagtggaaagcaagtatgaagctaccacagggagtacacagcattctcccttggtagtggttgcaactgaagaggtaaaagcattccactgaaatgctgcatccttgctgttagtggtttaagggagcctcggtctatgattcagaaacatttggttgcttcttctctcaggtactgagtactccaggcaggcagggcagaaaggtgatgtagggagctcatttcccctttcctagccccttttctctactctgtaaatgcattccttcacctaacactactaccaccttttccatatgagttgttggaagatgacaacgcggatttgctggttccagcccctccacccacagatattgcacttttgcccagagcccctaattctggactcacagatctatcctcctaacttccagtttcagctacgggctgctctggtcttcatacattaactccagatgaccaggaggatgttctcaagcagaaaaaatgaagaccagactaaaaccccacagagtcaacctccactcaaggaccaacaatcgtaataaacatcatcattccaaattcagtagctttttaccattaaaactttattcacgcagaaacagttttcttttatacatgaaagcacaaagtgctccacctaaactttgggttaaattaggcttcagcagtattccataggtcttctcatcctatgtaacatttctataatgagaacatactctggtttaaaataaactcattccaacataactcatatctatgttgggagggcacaaaatttaaagtgtttgcagccatatgaaagtgcaaggaccacacacacactgagaaaaacataacacttcctagacatttttttttttttaagagacggagtctcactctgctgcccaggctgaagtgcagtggcgccatctcggctcactgcaacctcggccttccaggttcaagcgattctcctgcctcagcctcctgagtagctgggactacaggcgcacgctgccacatccagctaatttttgtattttagtacagatggggtttcaccgtgttgcccaggctggtctcaaactcctgagctcaggcaatctacctccctcagcctccgaaagtgctaagattacaggcgtgagccaccacgcccggcccatagacctattttttaaaacccataatacttctagtttttatgacaatatgccagttgtaactatttcccagtcttctttgaggtaaatccatacatattcaattgtgatgcttctaaatatattcaaggatatgcataatacaatatctaagcatgtatttaatagacaagaatataaaacaagatgctggcatgactactattatatcaaggtttatcctactgaggtggtatgattcagataattaacactttctttttttttttgagatggagtctcgctctgtcacccaggctggagcacagtggtgcgatcttggctaactgcaaccttcacctcctgggttcaaacgattcttctgcctcagcctcctgaggagctcggactacaggcgtgcgccaccatgcccagctaatttttgtatttttagtagagatggggtttcaccatattggccaggctggtctcgaactcctgacctcgtgatccgcctgcctcagcctcccaaagtgctggcattataggcgtgagccaccacgccaagccagataattaatattttctaagcatctaagaaaccagtcttcatgaactccctcataaaacatagattaattcacagaaacacttacgtgtctggaaggcctacagtgaaaatatgatagagacagacagtagtctaatacaaaaactatgtagtgacagatctaaatataaacgtttaaattttccatttcattagttcatacttagattgaaagataaacatttaaattattttcaatatatgattctgctagtaatattctaatttcaatagaaaccaagtgcctttaatgagaaaagtacattttattctgtattaatgaatttccaaatgtaatgtttcaagtttagtcatgttatacttctaaccgtgtcactttaaaattacgagaaggaaaagagggatatattttgttcattttaataaaactacatgatacaaaatgcagttgaagaaatgtttgagttcagctacccctttatgacacacagcatccagtcaccaatgatggctttaaacactcgtgctctgggaaacgttcctaaaattttaaatactattccacaaaacaaaaaaacattgccaaatccctttatgacatgatacccagatctgtacaaaccttatcttcaaaacctaactacaaagagaaacaaagtgtttacctggctgggtctacagagctagtgtaagaactgtctcccagcaatggagtttaaactggcatcaaactctatcaagtgagccagaagaacacttttactaaaattaaaattccattttagattttaaaaggatatgcttcttaagccaattaaagttcctgtgaaggttgtaagcaactaaaattgactctggttagcataaggaaaggggatttttggaagactctcagagaccatcaaagggaggctccaaaagataacatacagagaccagagagaccaactggcaacatgcagggaaagggtcagcacatctccatggagacttccagggctgctgggctccacctcccactgtaaagccctgtggaagagccccaggctgcagaaactcaaagttccacacccaaagagaaaggaggtggagggggccctggttcgcttccctagtgggaacagccctgtgctttcctcatagaaactggggtgttctcaggaaggagaatagatcctggacagctaaaaagcaacaaacgtctactgtagattctcaataagccaatgataccaatatacttctcagtataagtcttcagatgaatttaggttatattcacactgttttggcttctgtaagactcaaagtagacaccccttgtagagcaaaaagggaataaacaccttctgcttgtgctgcacctagaatctttgttcaattctgactgtgatcaaaatgaataaagaatcagtatttgacctacccggtgccatatgtggtacctatcaaaccaaacaaggtagcaatgcacccaccaaaatacacttgtacacaatccaaataagtttgcacacctgtatttatcactttgatataaagaataagtttgtttcaatgcttttaaaaatatattttatgaatagtatgcatagaaaaatttcagttggaggttgctactgcccaattaaaaaggatgaaaaaataactgtcctaatatgatcaaactaccttataaaaatactaatgcatgaattgaatttcatgtagaatgagtcaaatattaatagtccaaatagggaagatatataaatttttattagaaacatgtttcaaaacacttctttaaaataataatttttaagtttcccttctccaaatggtcagtgttacaaatttggaaatatccctcatatagatgtactcaggagttagctaaaaggacatttgtttgtttgctagaaacgaagcaaaagataaatctgaacttagagcagcattcatcaaaacacaatcaaaaaatgctttacaacaaattcaatagaaaagagcatgcttccaaatggtaatggtggtatgtgcatttgcttgcagagacaattaatacatgcagctggtgtcaaccttccgtaaatttcaatcaaagcttgacagctaccagttatatttcacacagagtaattatagcaaatggcattcaggcttaatgttctgccatttcttttttttctgaaatgtaatcaacaagatattaagactgcttctgcttagttttctttaatattcacagtgacaaaaataaatattcagtctaaggcatttagtaaaaaatgtaagtgaggaaagaagactacgtttagtagggcttgtcctatgacaattacttcaaatatatgtagcctttctgcataataagatattatattagtccttctataatgcaatacaaaatcttcaatatgctttgttgttgttgtttttgagaagtttcgcttttgttgcccaggctggagtgcaatggcgcaatctcagctcactgcagcctccgcctcccaggttcaagcgattctcctgcctcagcctcctgagcagctggtattacaggcgcccgccaccacgcccggctaattctttgtatttttagtatagacggagtttcaacatgttggccagactggtctggaactcttgacctcaggtgatccacccgcctcggcctcccaaagtgctgggattacaggcatgagctaccgtacccggcctaaatatgcttctaattttctataattccaagacttttctatatatattgcacaagcatgtgagtatcaggcatcaaatgcttttgtatgttaaataaggaaacacaacagcagctccccctggaaattgtgttattctaaaagctggtgctcctacacattctttatgtggtgtcacaactaaaatagacattaggataacgaacatatggtccagatttaataggccatgtgcttcaatttttatagtaaagtatttaaaatgtcaattcttgtatccaaatgtacttttaaacttcatcccacaataattgcctatttaatcccactacacctgtgcctgctgaagtacacttaaggtgctctcatgctcccccagcttgctactcttttaaaatgttgctttctacacatcccgtcagtgtcctgggccaatcagcacatcttaggagtcaagggaaatcctgaagccgagagcactgtgcgtttgccttgctcctccctgggcctccattcggcccagcagaaatgggagcagtgcccagcaccctcccacctctgtcttaagaccatcaggattcatctgaaaacacccgatacccattctaataaccttctcattcacattctttctcccatcttctgcttaatttttccatcaccacatttactatggtctaacatagtatatattttatgtatccgtctgcctcctcgaatgtaagctctatgaaggctgggggtttgtctctgtttactactgtatttccagccattactaacaagtatctggtgcataagcagtactcaataaaataattatagctgaatatatttcacaaacttacaaaccaaaaaaaacttcactgtaaaatcaagtaagacctagtaggcatagaacatactctaaagaaataggagagcaaaatactgactacataacatttgtactttagcatcaatatacatcactgactgggatttaggagaacagaacaatacacagctgtatcagtcaagtttcttggcagctagcaatggataccaactttagctgaagaagaatttgctgaaaggtttttgggtggcccccgaaactaccaggaatgctgaagaattatgttcaaaaagggcaaaaaccagtaagacaccatgaagcaggactgaagccccaagccacacccgagaggcccacttctgataaggaccctgctgccctgggcagagacaaagctgctgaaactcagcagggacccagagatttggaaagggggattaagatgccggcaaggttaaaaacacacacatgcacacaaaaaggttcactatagtcatggtgtacaacacccttcacttgagtacttagtataaacatcaaagagaaaactcttccaggtattccttgtaacacagttatctcctaatagctgctataggagctattggtgatgacaggattccactataactgactagtatgaaagtgttaaggttcagtggctattaattagcactgtaagtgaaaatagttgaaaaactatgataaatttcacatatttgaacagcaatttagatttctgcaatatcaactggcattgaaaatgttacatttatttaaggtcgctcaaaataaaggtaccaaattgaagtatttaaaaccctctgtctttataacagatgtttttaaggcatcaaaaataacatgcatatgtgtacattcatgaggcaaatcagtaaaaaataattacacagtggcccccaaaccaggcattggcagggggatacctccagttccagagcaatcactgacaaacaaattcagtggtttgcatcttaaaaggatctgagctctttgacgaacaatttttgccactttaattctgcacagccataaaacacaaataattccagaatcttaatatactttcttttctctcttctcagaggtggaaaagggctgaccaggtatatttgaatttaagaaagacaatctgttcttttgagtctaaggattaaaaataacgggcacacaagagaaggtctctctcaaggtgttatgtagggcagggaaacaggtactgaaactgtgcctattgaaaagcaaactacagcaacaaaagaaatggaaacagaatacaaacgtgcaaagcatactgattattagcagaaacaaatccaaaaaaaatatataagcctattttctgggtatgcctcctaaaaatcctagaaaatacaaaatatagagaaaatcattttatttcatttaacaaatatttactaagcacctatcatgtaatgagcaatgggctagatactgttaatacagtagtcaatcaaatgaaacagttccttccctactggcactcagagtgttatgatgacacatcaatgacctcatcagcactagcaaagaggtgaaactgcaaactggaagatgacaggatgttataaggttcttatttcaatacctaaggatgtgttcttaatatacttgaattaaaaactcaaatcctttaggattttacaatacagtacttattttctgttgaattactagtagtagttgtaagccttatgaataattagcaaaaaatgtataactgcaaagtcaagtgtataaaaattgagaaagtaaatatcagattggcaactcaatttatatttctaaataacagaggacttaatccacattaaataaatctttatgtaggttaacaacaacaagatgaaagtgaacttcagataaggaagataaacatctactaaacagtcaaatatataaaattaaagcatagaaaaggccccagatccataaacctggctaaccaagcttcacctaaggttcctgttcaattttgctaaagaaggctatatgaccaatcctaggagaattaaacttccttagtagttcaaaatgatgctatatctgaaacttgctctctaagggaaattaaactgaactagttgctcctaaccacacagaagagagtaacaattaggcaaggaaggggctgggatagcaaaagagaaaaaaggacatccattaacactaaaacacattaagttacagtaacaatgatgactagtacaacacacactgggtggtgatctaccagaaccctttcaaagccttctacatgtattcattcctgtcatcctcccaatgccactataaaatatgcatgaccactcttgcacttaaggattaggacagaaacacagagaggcaagtcactttcccaaaaggccacagagcaaagtttcagatccaggcagccctgctccagggctccaaatcaccacggagcaacaggtgaggttagtggttttgtaacagcccatattttctcaatctctttttgaaacactgatgtgatacatgactgatttcaaagtagctcattttaaatattaggcattcttggacctgtgaaaaattaatcttagaggagctctatggtgatttctcatttttcaaacacttgcttctggctgggaatagaacgggaacttccctaggcatgtttaaagttggccataaaaaaaggtaatgcaaaagtacagttagataattaaataagtgttctcaaccacttgacagagtgaatcttaacacggcatcaggtaaaagtttgctcctttgttttcataaaatgtcaaccacttcaacaggccaaatctccaagccgaacagaaatcccataacttatcacccaaaaggatgactatggccatttccagaggctttctctgccactgaaatgctagtgatcaagtgtaattattaacaggtcaaggaataaattgattccagggcagtggaaattatgttgatgaaatgaaaagtggtcttgctgacaatgcattatcatttctagacagcacatctgaacatcaaatctcacatcatggagatgtgccaaatgccagtgacctagtttcattagggtgggaaagatagagcaatctatcctttgagactagtaccaaaatagctttctaaaatacagcttcatgcattaaaggttttaagtgattgtccatggaaggacaaaagtaataaccagagccaatatcaaatacaaatttcctttacgtaccccataagctaatggggtacataatattatctgcatttcaaaatttgaaaaaaaaattaggaacaggtcgagcgcggtggctcatgcctataatctcagcattttggaaggccaaggcaggcggatcacttgagaccaggagtttgaaaccagcctggccaacatggtgaaaccctatctctactaaaattgcaaaaacattagccgggtgtggtggcggacgcctgtaatcccagctacttgagaaagcgaagcacaagaatccactgaaccccagaggcagaggttgcagtgagctgagactgcagatgacagagtaagaccctgtctcccaaaaaaaaaaaaaaaagagtattgcatatacaaaattgttattaatgtgaattctcaaaaatatggcctatgtctatctacagagtaatgtgactttaataaaattattttggactctttttccaaacaataacaaacgagaacaaaacactgtaacaggtcattattttttcgaaactcaacaaaggttactgactcactttgcagcgccacatctaaagaaaaatgcaagtaatgaaacactaaactttttttaaaaaaggatctttatgtgatatgcacagaaaaacataaacactgaacttacaacatagcaccatggaaacaaaacctgtcaccttatacactggcaagactcaagaacaatagcttatagaacatagaggacaagaaacaagtctggaagacaatgggtttataaaatatgtttgccatgtggttttcttccccaagtaaagaatgtgaaaatgggataaaatcacctcttaaaagaaatgtattatacaacacctgtaatgccagcactttgggaagctgaggtgggaaaatcgtttgagcccaggagctcaagaccagcctgggcaatatagcaagacactcatctccacaaaaatttttttaaaaaaccagccaggtgtggtagggcatacctgtaatcccagctacttggaatgccgagatgggaagatcagttgagcccaggagttccaggttacagggtaagaccctatctctaaaaattaatactaagatttccacataccttttaaaatgttaagggctaataatctcatctataaaaatggatgcataaaataccattccaatttaagcatatacagaatccagaattacaatttagcatgaaagaataatataccactaccatgtacagttcattccagaaaagctagactctgtcaacaatggaaaatctatctaaataattccagtatcaaaaaatgtagtattatcaacatttcaagagagttccttaacatgattaaggaagtatatctcaaactaaaagccaggagaaggttttatggtaaaacagaagttttttgtaagagttgtaagtgaaaaggaaaggtatctaaaacctaacattaaatcaaaatagcaagctgcagaagagaatgtataatataataattttagggaaaaaatctatgtatgtatgtatgtatgaatatatcagtgtatgcatttaaaaatttctaaatggcaggcatcaaatcattaacaataattacttattggggctgttttccctattgtttgaatcaaaatcaagtgacatgagacaactacttttaagaaatcctcaattactaaaagatgaaattttgaaattcctcaaaattatttccaactatgattctgatttcctaatcagacattattagtgtttatatattttcctttttttaaaaaaggtagcaatattacttttgtctttgaatgctctgggagttaaatttggaagtaatgctattcctttcttattaactgagattaaaacagtttggtatgcaagattccccaccaaggggacacaggctctgagggtagggtgctcaaggtttccccactggaggaggcatcgtagaggcagcaggtgagttttaatgatgaggtgtcaggaaagaaacagcagaaggtagaagaccaaggggaagaaattgtaggaaaagaaaacaacggagggctggcaacatgctgcatgaagtaagatcacacaatagcactgccacacaagggtgccatgcctagcgaccacaggatccagcaatatagtcacaaagtcctactttaaaatgaaaaaataacggggaaagcaagacacacaaatataaaaacattctagtttcacagtgtaatcttacgcgtagcaaaaagattattttataaaagtcaattttacatacgtagtaaagaaaagaaacctgaacactgaggattttttttccatctcttccacaatcttgacagatggtgctcactctgagtgacaagtaactataaaaaccagtaagtctatttcaaaggaaaagtggtcctttaaactactcataccaaatgccttttaagatcgtcactgttaagtctgatttcacctttgtgggtaacaaatcttggaagtagtttggcgcgatttcaacgaatggaaaaatagaaagtctggatatacagtaagataacttttctgattaagtggttggtcatttcacaaaaataatgcaactgaagaatagtgcatttattaatttaatgaatcatagcccttcctcttccagccaagatagggtagcaaagactggatttaccttcctacctgaaaaactcaaaaaacagttttcaagacactggataaggcaacaaaggacagtaactgttgaaacaagcgacatgagcccttagactgcccaacctaacttggatgaatatcaaaataattatgctcaggaaaagaacccaggcaaagaaaagattccgtaagggataataacatttatgtcaaattctggaaacaaaagctaatcttcagtgacagaaagcagttcagtggtggcatgaaaaaacttttaagagttttttctcttcttcattatcttggttatgatttcatgggtgtatatatgccaaaacttatcaaattatatgctaaaatatgtgtagtttattgtacatcaattataacttaataaagctgttaaagatattaaaaatgaagaaaaattatcgcaaacaaccattaagtaacaacaaaaataaagtgttagtccttacaacgtgccaggtaatgacataggcactttacatgtattatcctagtcaattctcacaacaacctatgatataggcattattattatctttattgtacaaaagaaactgagataaataatacagagaaataacttgtctaaagaaatacagttcagtgatagagatgggatttccaacagtattaggctatttgtgttgctataaagagatacctgagagtaatttataaagaaaagaggtttaattgcctcccagttctgcaggctgtacaggaagtgctgtatcagcatctgcttctggtgagggcctcaagaagcttacaatcatggcagaaggcaaagggggagcagacatctcatatggtgagagcaggagcaagagagcaaggagggggaagtgccacacagttttaaacaaccagatcacctgtgaactcgctcatcaccaaggggacggtgcaaagctgttcatgggaaatctgccccaacgatccagtcacttcccaccaggcccctcctccaacactgcgggtcacaattaacatgacatttggtggaaacaaatatctaaactctatcacaagccaagagggacctcactccaaagcacatgccatgagctacttattcgactccacaggtagacatggctagtcatcagatgtttaaccataaatgttactgctgagctagtgtgttcagttttcttaaaggaatgtaagcttaactctattattccaaatcagagttcttgttatcattagacttgacatttacgtctgtcggatggcatgctgacaggtacacactgaaatatctctctgatggtaagtccaaacaattcacaccctgtttttcacattacaggcactagaggttcaaaaaagcagtcaccaaactggaaggtttgtaaaaagtgaattcagttttatttttaaaagataagggaaatgaactgccgctcttcttaatttataggcagaactaatttaacttccttgattaactttctacatattctatttaatgactctgagaaaaaggtaggtctttcaacatctgctttctagactgcttaaagtgattcttgagaccatttatttaacttgatacaaaaataaacactatagaatattaaaatgtaaataagaccaccttgattactgctggataataagaaagtaacctgccactcataaaatgaataacctgttttttctaagagagcaagttactagcaatttttaaaaatgagagcaataaacactgacataaatttgaggttataaggaggaaattaaaatactcataaccaaaatcaccaattaattagattccattacttacataatttgaacacataaataaagctaattttaatgaaaaaagggcagttaaagtaaataacatactcatattattaattctccaatcttttctgtataactatcctttgaagttaatctcattctcttttctccaggagcagtaatttacgcattcaaatatacacactgaggacttaccagtgggctaggccccttggtcttacactcgagagaacaagagatgagcttcaaaaacttagttttacatttatgatctattttgagctaattttggcacaaattatgaggtttacatcaaggttcttttttattattttctgcacatggaagtccaatttttcctacaacacactttctccattgaattgcctgtgcattttcctctttcaggatttttttaaaagtcttgaattttagggagtttatttatgatgtgtctgatcgcggatttctctgggcttgtttaggtttactcagcttcttaaatccttatatctttcaccaaattaggaaagttttcaaccattatttctttgattttttcccccctgaaatacactttctcctctccttctggaacacttgagacacaaatgtttaacctttcagtattatcccacaggttcctacggttcagttcatttattttacacaatgattttttctctgttgttcagactgaataataatttctattgctctatcttcagattcactcactctctcttttgttcatcttcattctgcaattcagtccatccagtttgttttttattttggcaattttattttttaatcctaagatttttatttgttggagttactctcctggagttctctctgtctgtaccaatgtccatttctgtgtttcaggatgcctttagaacaggcctctggaaggcaggaaaaaaatgaatcccacggttttttattttccacccaggctgctctcgaaaactccacatctgtgtaacagtctacttaaaagtgtacttgatatttaatgaccattttgaagccaacacgtccaaaacaatattcttgattgtcacttcccaacttgctttttgaatagctttccacatctcagtacaaggcaacctctcttttcagttactgcagccagaatccttggagtcattctttacatcggtttcttttatgttacccatctagtctatcaagagattcttttggctccatcttcaaaagataccgagaatctaaaccataccccactactttcaccattcccatcccagtagaggcccctatcacattccacttcaactacagcaacaggctcgtggcaggaataggcttcttccttctaacctggccctactattgtctgctcctaacacagtgatgacaatgaaccttcaaatatctaagagcatgtcacagcacgtcacacctctgctgaaaaacctacggtgagcccccttctcactcagggtaaaagttaaaagtcctgacagtggctataagacctctagatctgactcccctattgcttctctgacagtatctcctattgctctcctcctcctcctctctgctctggttgtggtgatgtggtgaatgttccaagcacactcccatctaaggcctctttactagttgatacttttgactgacatgcttttcctcagatctgtatgattaatttcctcaactcccttaagtctttatttcaatgttaccttttaaatggggtttgctctgacctcttggttttaaactacaaacccacactctccttggaccccttcccctattttttttttctatagcaccttccacttctgccataatacacaatttatcatgtgctaggtctactgttcctgtgctagaaggtaactgcttggtggcaggatcttcctctgcttgttcacggctgtatccccagtgtccacatcagcacatgactcaacaaatgtctgctaaggcaagtgagtaaacatgcctggaaaacagtatgtgagcaggaggagcagtggtaggagctgaggtcagagaagtagccagggacccaccttgcaggacatgtcatctattaaatcttggtgatggctccgatcccacggaaatacaaactaccatcagagaatactataaacacctctatgcaaataaactagaaaatctagaagaaatggataaattcctggacacatacaccctcccaagacgaaaccaggaagaagctgaatccctgaatagaccaataacaggctctgaaattgaggcaataattaatagcctaccaaccaaaaaaagtccaggaccagacggattcacagccaaattctaccaaaggtacaaggaggagcgggtaccattccttctgaaactattccaatcaacagaaaaagagggaatcttccctaactcattttatgaggccagcatcatcctgataccaaagcctggcagagacaccacaaagaaagagaattttacaccaatatccctgatgaacatcggtgcaaaaatcctcaataaaatactggcaaaacgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatgcagaaaaggcctttgactaaattcaacaaccttcatgctaaaaactctcaataaattaggtattgatgggacgtatctcaaaataataagagctatttatgacaaacccacagccaatatcatactgaataggcaaaaactggaagcattccctttgaaaactggcacaagacagggatgccctctctcaccactcctattcaacatagtgttggaagttctggccagggcaatcaggcaggagaaagaaataaacggtattcaattaggaaaagaggaagtcaaattgtccctgtttgcagatgatatgattgcatatttagaaaaccccattgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattccttcaaagagaataaaatacctaggaatccaacttacaagggatgtgaacgacctcttcaaggagaactacaaaccactgctcaatgaataaaagaggacacaaacaaatggaagaacattccatgctcatagataggaagaatcaatattgtgaaaatggccatactgcccaaggtaatttatagattcaatgccatccccatcaagctaccaatgactttctccacagaattagaaaaaactactttaaagttcatatggaaaaaaaaaaagggcccgcattgccaagacaatcctaagccaaaagaacaaagctggaggcatcatgctacctgacttcaaactatactatgaggccacagtaaccaaaacagcatggtactggtaccaaaacagagatacagaccaatggaatcgaacagagccctcagaaataataccacacatctacaaccatctgatctttgacaaacctgacaaaaacaagaaatagggaaagaattccctatttaataaatggtgctgggaaaactggctagccatatgtagaaggctgaaactggatcccttccttataacttatacaaaaattaattcaagacggattaaagacttaaatgttagacccaaaaccataaaaaccctagaagaaaacctaggcaataccattcaggatacaggcatgggaaaggatgtcatgtctaaaacaccaaaagcaatggcgacaaaagccaaaatagacaaatgggatctaattaaactaaagagcttctgcacagcaaaagaaactgccatcagcgtgaacaggcaacctacagaatgggagaaaatttttgcaatctactcatctgacaaagggctaatatccagaatctacaatgaactcaaataaacttacgagaaaaaaaacaaacaacctcatcacaaagtaggcgaaggatatgaacagacacttctcaaaagacattcatgcagccaacagacacatgaaaaaatgctgtatcactggctatcagagaaatgcaaatcaaaaccacaatgagataccatctcacaccagttaacatggtgattattaaaaagtcgggaaacaacaggtgctggagaggatgtggagaaataggaacacttttacactgttggtgggactctaaactagttcaaccactgtggaagacagtgtggcaattcctcagggatctagaactagaaacaccatttgacccagccatcccgttactgggtatacacccaaaggattataaatcatgctgctatgaagacacatgcacacgtatgtttattgcggcactattcacaatagcaaagacttggaaccaacccaaatgtccatcaatgatagactggattaagaaaatgtggcatatacacaccatggaatactatgcagccataagaaatgatgagttcatgtcctttgtagggacatggatgaagctggaaatcatcattctcagcaaactattgcaaggacaaaaaaccaaacaccacatgttctcactcataggtgggaactgaacaatgagaacacttggacataggaaggggaacatcacacactggggcctgtcatggggtgggggaaggggggagggatagcattaggagacacacctaatgtaaatgacaagttaatgggtgcagcacaccaacatggcacatgtatacatatgtaacaaatctgcacattgtgcacatgtaccctagaacttaaagtattaaaaaaaaaaaatcttggtgatggctgacagaagccacactgtttttctgaactcattgactcccagctttatattgccttatccctgtttgactacaacaacagtattataaagggcagttatgatgtttgctcacgtttcatctctcctaacagattttaggtgatcaattccaagggagcattactaagtcctacataaacctgtttattccacagctactaacaaaatggtctgtacacagtacaaagtcagcaaataactcccaaaccaccctaattacacaaaaagaactagtcactgaattacactttaatgtataaaaagatgagacttcatagtgtgtgctcgtgtatacgcaaggtatgttaataatgttaatatgttaataaatacactggacttcagaaggctgaatcagtgccagctttaaggaagtcacctggggaagtgctacactaaacccaactactctgttctttcttcacatcggtaaaatgtcaacattatgtaagcctcttttttaaaaaaaatcgttttgttatgcttttttttcttcctggaatagtatgaccttattaatcatatttggcacagaatgatcttttgatatttatgaaaatcaaatttaccctcacaggataaaaatgagtcactgctgaggatatttaaaagaataagctcagattctgacggaacttctaaaaggatctcaacaaaggttataaacaaagcctttcaaaatgactactgtgttcaggactacacacactcacaggatttaaaatcgagttccaggaaaacatgccaaaagactgccctactgctgaacacagccaacaatgatgtacagtaatgcccccagatccctcacccagggaggggaaaaaaagacaaaactggagttggtctctttttctggttccatgaaacctctgtgctctaattttccttcttcctttctttttaaatttggaaatagtcagccaatggtaattactatagcttcttttcctgaaaagtttctaagataatcctaaaaatatgcccacatttgtcactaccccaaccaaatgatcaaagatattatcacccaaagtgggatgacctaacattaggaatcacataataaacacaaaatgaaacatgcagcattgacattttaatgttgttggcaaaatgtcttaccctaaacctaaccatgaggaaatattaagttaaatctagaatgagcaagactcagacaatcgcctgaattctctaaaaaaaaaaaaaaaaaatctatctatctacctatctacctacctacctaactacctatcgtgtttgtatggggacactgaggagatgttagccaaagtacacaaactttagacatgaggaataagttcaaaagatctactgtatgtcatggtgaccacaggtaatgataacatattatatacctgaaaattgctaagagtagatcttatatgttctcaccccatatatacacacacactaatgagtatatgaggcaatacatgctaattagcttaatttaatcacttcacaatgtgtgtgtgtagatatatataaaaacactctacatagaatttttacttgtcaattagaaaaataaaatacttaatcctttaaaaaaaatgggtaagtatcatgtttcaggttaaaagaaaagttaccatcaccaaacatgagacacagggacatcatgcaaccccaataggatgccctgagaagaacacaaattcttgccaaaaatgaataatcttaatttattcatgaggaaacattaggcaaactcaaaaataaaagacattccacataattacagactggcactcttctaaattgtcaagatgattaaatacaaatttatacactgattaaatacaagagacaaaggagacacaccaactaaatgcaacgtggaggcctcaactgtcttgaaccagaaaaaggacacttgtgagaaaagtgacagcatttgagtaaggtctacagattagttagtaataacataccagtattaactgtctacttttgttaactgtggtacagttctataacatgttaatatttgaggaagctgggtaaagcgtacataagagtgatttatactatctttgtaactattctgtaaatctgaaattactgcaacatgaaaagttaaattagtgttatagaaaacaaaaaacatgaatgaggtactctttcaaatttgaaaaaactacagatttaaccaaatgaaaaattaatcctgaactggaaaaacaaaatacaaaaagacggctacagacaactggagaaatccaattatgaatcatatattaaataatattactaaattcctgttaatattcttgggtgtgataatagtgttgattatgtaagagaccattcttgattcttagaaaacgtatgctgaaatattgaaagactcatctatattttgaaatgtttctatgagaaagaaggatttggggaatggaaggagaaagaaaatggaaggaatagatctttgtaaagggtataaaaatgtgtgttttactgctattcaaacttcctagtttgaatatgcctccccccagaagctggggggaataaaaaaggaattcacagagcagtggaaatacaaagcatctcaatcccagtggtgtacacccaagcaaaaagccttaacaaattaccttagtaataataaggtttcctgacacagaccccaaaacctccagtagaagaggtaagaacaaagagcgggaattagaaaatctgccactattttctctgtaaatttaaagagatactgtcaaataaaaggatcttaatcctctgaacttgtatttcatccttgcaaatgtattaaaggaaagtactgttttaggaactatttctaaaagagaattttattttataatatttgcatattctcccagttgggagaggataggaaatgtaaatgctttcttaaaggtgagaacgttggagacgaaactagggctatatattgtacaaaaatccccaataaaattacgacaaggttctggggtaaccatttaaattatttttaaatgggccagtgcttcaaatcaatagtgtttcactttgtgtttaatattggtaatcaaaaacatatatacacatatatatattacaaataaaagcattggttcaagtatttgatagtcaaattacatcccatcttttaattacatctgatataactactacttaaggaggttcgattttgttttaatgtttccacattccttcacgtctttctttttattgcactatatacttttaatagtcatttgatactaaacaatattctttctaataaaaactaaaattgagccttctaaattaaaaactacatgatagcagtggtccattaatatgttcaatagaaatattaccatctcttcaaagtcattattttataatagcatttttttaatttacaaaacataccttaaaaatcaacatattgctacgcaggtcaaagctcaggtaaagaaaacaaaacaaaacaaaacactattttttgacaaattgttttgctgtgaactgctatcagaaaaggccagaagtgatgatatgacaatcaatagcatcacattaattctcttgtctttatcaaatgtacagtaaattcaaataaggagatacaatttcatttggattaacttacaaatgctggccagtatgaaatcatggacctgtaataacttagcagaagattatttgccagattttaaacatctgttttctagagtggctacaattcatgtattttacccaaagatatttactttctacataatattaagaagaaaaattaagcatctattttttccacaatattttccccatatttgaattctccccacttattttctatttttttggctgtcagcacctgctcatctggaaaagaggaagagctaaggcagctacagtggagcaaggctcactggcaatggccaagccttccctgcagagtgcacccctggctgctcatacaagcttctataataggaggcaagtgacgcattttcttttaaccaaaagagatctaccaagaagggagaaaaaaattaaatacagtctactgtgtctattatagaaagctctttacaacatttaacagaaatgtttatacccaaaaggaggatatctcagagatcactttaggcatggcaaaattcaccaatttaaaaacacaatttttgaaaaaagcagtcttttcatatcatctacaacaaaggaaagaggagaaaggagatggcaaaaatatctatggataaaaaatcttctgtggatggagcagaagaagatttttctacataaaaatttcagaatagctcctttaggtaataaacacaaaaacgtatttttaaaataaaatctctgctgtttcaaaagaacaggcatcacctagggtactttaagaactgtaatattaatttaaaagtagaccaaaaattctgtgcatctcttatctaaatgtgaatactattgaaatttttattaataacgaaaatgaatctgattttcatttacattaaaaaattcaaagctacataacattttatgagctatgaacttgaaagcttcatggtattaaaagaggaactaaaatacattcctcaaactcacttaggacaaaagaggtcagaggcagtggctcatgcctgtaatcccagcactttgggaagccaaggcaggaggattgcttgaggccagaagttcaagaccagcttgggcaacatagtgagaccctgcctctacaaaaagagaagaaaattagccgagtgcagtgctgtgtgcctatagtcccagctactccagaggccgaggtgggaagatctcgaacccaagagtttgaggctgcagtgagctatcattacatcgctgtcctttagcctgggtgaccaagcaagaccctgtctccaaacaaaaaaaagaaagaaaagaaaaagacaaccatcctttgtaagtacatgggaatatgtcaaagcattctgacttttatgacaaatttatttaatagaaactagaaaaataattctatttgtcagaatatgtagtccaaattcaatcaaacctacaaaaagtaggttctaattaatgcagccactattgcagaggactctaaagaacttaagtatattgggaaaaaattctagtttctagacctcatatggtatggcacagtgagttcacaagacaagacagaagaggttgttatagcataatctatcttttctcatctaatcaaaccaaacactgctctctatcttctggtagttgtaacacaaaacttttcataatcaagtcacagtaaatatccaaattaccaagttcatcttgctccctccccaaatttctgccacctactaacccccatctgtccccaaaaatcatgtaaacatcaccaaaaagtcgctgtattcattgctataacaaattgccataaacctggtacctctgaacaactgaaatttattctctctcagttttggaggccagaaatccaaaatcaaggtgtttgtagtgtggttccttcgagaggctctgtgagaaaatctgttccatgcctctcacccatggcttcccgtggctgccgacaacccttggcattccttggcatgtagatgtattactgcactctgtttctgtcttcgcatcaccttctcttcttctgtgccttcctctttcttataaggaccccttgtctttggatttaagcctctctcagataattcaggatgatctcatcttgagatccttaattacacgtgcaagatgcttttccttccaggctgacatctcttggtgtctgttgggggggtgggggtggaggcggcatgccatccaacccactacagccactatctttctatcttctaggattaatcacatcctcattaccaacaaatgcttacttctcaaaagaatttcagaaatatgtcacatcacccttttgctaaattttgctttatttcacatattagttatctgggaattctttttaaattgatccactgtcttataaatccttctggtgttttttattagtcacagtgaaaaaggcaggcataatagagtaagtatatattaaatgttttggcctacaagaataacattttcatcaattaccaaagtagaaaacatggggagtcttacacattcatctgggcagtcttcaatttcactgtaacctatgttttaaatttctacctatcagaataaatactcttttaatgataaggttaaccacacaattttaaccaattcatatgcaagtatgtcttccatgttcaacactgagtttaatatttacattgttactgttgtttcattcatactctaagcatcatttagcatacataaaaggtaccatgagccaagattgtgccattgcactccagtctggcgacagagtgagactccgtgtcaaaaaaaaaaaaaaaaaaaaaaaagttccaaggaaggttactataacatgcatatccttaaatgaagtctactttttgaaagaatgacttcacaaaatgggaatgcctccaaattctctgaatcaaaagaccaaaaatttcagatttattgggtgatgcaagatttcattatcaattttggaaagatgttttcttaaacggctctttcaagaacagaagctcatctatttttttcataggaatagaagaaacaacacctcttcagctctaagttcaggctacccactaaccgcaacttttgtcccactgcagagaaacacaagaaaggtggtacaaagcctgggaaccctcttttttttttttttttttttgagacggagtctcgctctgtcacccaggctgctggagtgcggtggtgtgatctcggctcactgcaatttccaccatctgggttcaagcaattctcctgcctcagcctcccaggtagctgtgattacaagcacgcaccaccatgactggctaattcttctatttttagtagagacggggtttcaccaggttggccaggctggtctcaaactcctgacctcaagtgatccacccgcctcggcctcccaaagtgctaggattacaggcataagacaccgcacccaggcacctctcttcttcttccacttggggtttcactgtctgcatgaagctgttggtgaggacacacacatttaaatgcacgcataaaagctttaaaatatttgtgtaatcctttaggaaaatagatccaaacagtgacaaaaatgtaattagcacagtaacttaaaacttaagaactaccatcttcactgtctacgtaagctaaaaatagggcatacaggcatacctcattttgtcgtgcttccctttattgtacttcacagatactacatttttacaaattaatggtaaccctgcatcaagcaagtctattggcaccatttttccaacagtatgtgcttacttcatgtctctgtgccatattttggtaattttcacaatatttcaaaccttttcattattgtatctcttatggtaacctgtgatcattaatctttgttgttactactgtaattattttggggcaccatgaaccacgcccacataggatggcaaacttaaccaataaatgcatgtattctgacggctcaaccaacgggctgttcccccatctctctccctttccttgggtctctctattccctgagacaaaacagtattgaaattaggccaatgaataaccttccagtgacttctgcagtgttcaagtagagcaaagatccacacgtctctcactggaaatcaaaaactagaaatgattaagcttagtgaggaaggcatgtcaaaagctgagatcagccaaaagctaggcctcttgcaccacttaggcttagttgccaatgcaaagcaacgtttcttgaaggtaattagaagtgctactccagtgaacacaggaataagaagaaagcagaatagccttattgctgatatgcagaaagttttagtggtccgtaaagaagatcaaactagccacaacattcccctaagccaaagcctaatccagagcaaagccctaactctctttaactataactcttaactctctttaattctagagttaagtctgagacaagtgaagaagctgcagaagaaaagttggaagctagcagaggctacttcatggttaaggaaagaagccatctaccgtaacacagaagtacaaggtgaagcagcacgtgctgatgtagaagctgcagcaaattatccagaagatctagctaagatcactgatgaaggtgcctacactgaataacacatcttcagtgtagacaaaacagcctactattagaagaagatgttatccaggactttcatagctacagaagagaagtcaatgcctggcttcaaagcttcaaaggacagactgactcccttgttagggactaatgcagctggtggcttttagttaaagccactgctcacttatcattcccaaacttctagagcccttaagaactatgctaagttaactctgcttatgctttataaatggaacaaataaaacctggatgacagtgcatctggtttccagcatagtttactgaatactaaagcccactgctgagacctactgctcaaaaaaaagagttctttcaaaatattactgttcagtgacaatgtcctggttacccaagagctctgacagagacagacaaggagatgaatgttgttttcatgcctgataacataacagccattccacagcccatggatcagtctactttcaagtcttattatttaagacacacatttcaggctgggcgtggtggctcacgcctgtaatcccagcactttgggagcttgaggcaggcagatcatgaggtcaagagatcaagaccatcctggccaacatggtgaaactccgtctctacaaaaaatacaaaaattagctgggcacggtggtgtgcacctgtagtcccagctactcaggaggctgaggcaggagaatcccttgaaccggggaggcaggggttgcagtgagccgagatcacaccactgcactccaacctggcaacagagcgagactccgtctcaaaaaaacaaaacaaaacaaaaaccacatttcataaggctatagctgccatagacagtgattcctcttatggatctgggcaaattaaattgaaaaccttctggaaaggatctgccattctagatccctttaagaacattcatgattcatgggaagaggccagaatatcaatattaacaggagtttggaagatgatgattccaatcttcatggatgacttggagggattcaagacttcagtggaggaagtcactacagatgtggtggaaagagcaagagaaatagaattagaagagtaacctgaagacgtgactgaatttctgaagtctcattataaaactggaatggatggggagttgcttcttgtggattgatctggtttggctgtgtccccacccaaatctcatcctgaattgtagctcccataattcccacatgttgtgggagggatatggtgagagatcactgaaccatggaggcgggtttcccccatactattctcgtcgtggtgaataagtctcaggaaatctcatgctttttttaataaggggtttcccttttcccttggctttcattctctctggactgcctctacgtaagacatgcctttgctcttcctttgccttctgtcatgactgtgaggactccccagccatgtagaactgtgagtccattaaacctctttcctttataaattacccagtctcgcatatgtctttattagctgcatgagaacagactaatacatggacaaataaagaaaacagtttcttgagatggaatctactcctgataaagatgctgtgaacactgcagaaatgacaacaaaggatttagagtattacataaacttagttgataaagcagtggcagggtttgaggattgattccaattttgaaagaattatgagtaaaatgctatcaaacagcagcgcatgctacagagaaatctcttgtgaaaggaagagtcaactgatgtggcaaactgcactgctgtccttggaaattggcacagcacctccacactccagcaaccgccactctaatcagtcagcagcctcaacatcaaggcaaaaccctctaccagcaaaaagattatgattctttgaaggctcaggtgaccattagaaaatttagcaataaagtatttttaaattaagatatgtacattgtgtttttagacataatggtactgcatgcttaacagactgcagatagtgtaaacataacttttatatgcactgggaaaccaaaaaatttgtgtggcttgctctatcgcagtatttgtttcattgcggtggggaaaatctgttaggtatgcctgtaacttgaatggggactttgctagggatgcaaacaatatgccattgtctctttacgcaaaatgttgcctttccaattaacatgattttgccttatgccctgtttctaggaccaaatcaaggatttgaggaatgggcgtgaactactcatacctccaccaggaataatcgccaattttgtttcaaccaggcccatttttgcagaggaagctaaaacgaaagaaagaaaattaagtatcatccatatcatcacattcaaatatgacaacttgaaaaagttatgagatatactaaaatattgtttactaattaaattgatatcacaaattcttaaaaaaaatcacttaaaaggcattgttatggaaataagtaagcactctaaatgacatgtattaggagagtcccacaacattttctgttaaaaactgcttggcagtgaattaatttttgattcacaagaccaggactgtaactccattattagacccaatattgccaagacatatttggaggcatagatctattaattattcaggatcagcagacttgtcagtatctgacaagcccaaattcttcagttgcctgaatatagtcccccagaccaaagagcttaataggtcatatcagatatggcaacttttcaagaccaagtctttagttaccttctgacaaatagttttactattctgacaggtggacagggttcctcttttcatgtctgttttcatggctactttaaaacatcttaataacttctttatttgcatatccaaatatacttagactacttcccatattctaatttccaaaacctgtattctttcagaaatggattacatgtaccttagcttttcaatttaaaatccaatgatttcattacaagaaaataggttcctaaaatgaagtgaaaaggaggaaaaaggacacatggactagcaaccagaaatcccaagaaactgaatcatgttgacgctacattgttctaaaaatttaaaaaatcttttataaagatgaggtctccttatgctgcccaggctagtcttgaactcctggcctcaatcaatccttctgccttggcagctctgcttttaacatgcagccacatcagaaacgataatggaaagcaagagaagaacagtgacaactctgtgccgtctgctgtgcccagttctcagtctcagagcccgaggacacaggcagagctgagtctctatggatatagtgtccacaacgatgaatatgggagatcagtctacgttgctctcatgaggtaacaggtgtgtgggctgtggccaaacagtctgggttcaaatctcagttcagtcacttctttggggcttctctcccttctccagtttcctccagtgccccaaagtacctgctctgagggttgttatgcagatggagtgagtgaatacatgtcaagtgctagaataacactgggtgcctggactgcacacagtaagcagtgggcactaattcttttcactctttttctattcacctcataagatcctcagaaaaccattcaggaagaaagtggacttcaaggagattcagttatcattactgtagcaaatggtgatttagtacttagattaacatccacagattaattgcttaatcttcacaacagcaacagtcatttcccccatttcctctaaagaggaagatattggcctaaaaaagggaggacctcagattcttttcctttttttctttcctttttaatttttttttttttaaacagggtctccctctgtcacctgagctggagtgtaatggcacgatcatggctcactgcagcctcaaactcccaggctcaagtgatcctcccacctcagcctcccaaagtgctgggattagaggtgcaagccacgcgcctggtccaggacctaagattcaaactcagttctacctgacccaaatcctggcaagaaacaacacaagacttttttcaggtgggaatttcgaaaacaccattaggaccaacaagtgactttttgaaaatattctactcaacaacaggaagcagaataaaatatttaaaattacctgaagagtaaacacaaccttcacttttttaaattatgtttttaacaggattaattcttacctgctactcgtatatcacaggctaaagccagttcaagaccaccacctaaagcgagtccatctattgctgcaattgttggtactggaagattagctgaaatggaaagaaaattttatgcttccttaataagattattatctcactgtgtaattcatttttaatttttttctgtgaatttatgctttaaatgggagatcatatacagacttttgtatcccttttacctttaacaaaatataagcatttccatcattattcttcaaaacattatataattactgtatagtgttccatcacatgtatgtgcaatatctttaaatcttcccatattattgaattactttcataaacattttttgttgaattaacagaatcacagttctacgatttcttaatcttagagccagaagtctttcacaagatgtttggttcatacaaagttcaaattgaaatgacttatacataattgtgaaatttatgatcctttatgggctacttcagtgcttggaatgacagagtctcattcaaagaaagacatctgctcaaacaagaaagaaactgtccaagtagttgctgtggcattggcccgtgagctgtcatttagtgaggagccctaacattatgaatgggagctggaaaacaatcaggctcttccacttcagaggcaagatgccctgagaacctgctcacaagcatgcctggaaaggggtcagccagtcacagaactaaaagctcaacttgcttgaatccagaaattgagtattattttaatacaacttttgtaaattatgacatacagatttcattttcataaccagttcaaaaagtgactggttttattagttattctgaaaagcagaactctattaattttatttctgactatgggaatgtgaagcaaggctggccaatgttaatatataacagaaagtggattttaaaaaggtaatatcggccgggcgctgtggctcacgcctgtaatcccagcactttgggaggccgaggtgggaggatcacctgaggtcaggagttcaagaccagcctggccaacatggtgaaacctcatctctacaaaaatacaaaaattagccaggcatgatggcgggtgcctgtaatccaagctactcaaagaggctgaggcaggagaatcgcgtaaacccaggaggcagagattgcagtgagccaagatcgtgccattgcactccagcctgggtgacagagtgagactgtctcaaaaaacaaacaaacaaacaaaaacaataaaaaggtactatcccccaaaatctctctcttccattctgatatgtaaaatcccccagaggctcactccttgactccttttaaaatatacaaatttgctgaagtacactgagttttattcataaataaaggaattcatcacttattgaagatcaagtctgaaaaggccaggaaggagcacatatacacagctgccgcctgaagcactcccagaagagcaggcgtggaaggggcttttgcacaggcagtatttcactatctgtacctgtctgaacatttaggggttgggggtggggagggacttgaaaggacaggacaaattcaaaatgtgctttccagaacacttagtgaaaaaaataacagctatgtcagggtttgcagtctggaaatgagtttaatgtgcaaacaatatctagtgaattttatctggaaaaaagaaaagaaaaatcaataaaaatataaaacagcaagttaaactgagtccttcccaaggtcatcctgagctactacaagtagaatgtaatgactttggttaccgactctcaactcctcttccttcctaaaaacctgtctagagatcatttatttctagacctcctcaacctactatctctccaacctcaagtctcacccgtcagaagccttccttaggccttgctaaggccctccagctcacctcctttacagaccagcttctaagaggagtagagtaaacccatgccaccatacccattcacctccaaacaagcaagaccattcttgttccagttaccaatgacattataagattgtcctatagccagtggacaatattcagtacctattaaatgtactgcctcaaaagatcagagacatccatcctggacactccctccttgtattcctcccttcactgcctgctgggtccctcatttttcctgcctttccatctacctctggtaatttctcagccttcttcccctctcaataaaagctcttcccaggagatctcattctcatccacaacttttaccacctatactaccaccaatgatttccagatctctacctcaaacccaaacagccccctgcctgttggacatacccacttaaatacttcatgtgtccaaaccatttcttctcaatccttcttctaggctgtatttcagttagtagcacctccattcatcaagttactcaagacactcagaagtcatcccagatgtcctccttgccaatgcccttttctaccacccaagttctgggtcccatcatttctcaccagcaggaagtacctaattaatctccttcacctgcaatctgccacccttctatgcatcttctacctttcctgtagggtaatctttctaaaatgtaaacacagtcatgctattcccctatttaaaactgttcaatgatttattctaccttcaggatagaaatggtgtaaacatttagcatggcacaggaaggcacctggaactaagttctgcacacctgcctaatctcttccaaaacctcagatattctgttccagccccaaactacttaaaacagctccaaaagtctccattcaagactcaatatctgtatacaaggtgcagctctgcctagaatgcctagctagcccctacttgtctgtcgaggctcaaatgtcccttcctctatgcttacatggcactctgtgcataaccttttctatcagaacattcattaccatacagcccatatgaaacaaaaattaacatcacatcaatgctactcaataacgttcttactaatctgggacaaacctcacggtttttcactgcctcttcctcctttattatattaatcctggtattttgcctacttttcttttttttattaacttcttttgtttaataaagaaataaacatatgcagtcctatggagctaaagaaaagaaaaattgccaagagttctaagatggagagagcagaagcagagaaagagtgggtgctccctccctgctacgtaagtgctgaagtcactcagcaagtagctgctggaggccgtgatattatgaaatacatatttggtcttcatccctgtttccagacacacagctcttaaaacccttggaatctctggagtgataaatgcatctttcttatttctccaataagtttatactttttggaattaataaaaactatttttaagtctaataggaatttgagccaggtacagtgactcatgcctgtaatcccagcattctgggaggccaaggacgaacgattgcctgtgcccaggaattcaagaccagcctgggaaacatggtgagacctcgtcttgattttttaagaaagaatttgagaaattatgtttctaaagaggatgaaaattgtgtgcccttgagaagcttaacaattccagggcttgtttccttttgtgcaggcccacaccagggtcactgcaaaaagagccagcctaggtgccaagagacataccagaggtgaggaccagggcctgcagatggaagacaggagctccaagagcaagtctcaggcaccatatgccttacaatttgtaagaaatacgtaacacaaaatgatgagaaatttgggttccacatacaaaaagaacaagaaaaatgggatactaattctcatattattaaataggttaagcactggaactttaaattattaattaacataaattagccttgtagaaagctgtctataaaatgtttctaactaaagaattaagtaaaacagcttaattcgtattcaatgggtaattaaatattagtcattttacaatattataaattctaaggctatacatcatcctaattattccctaaaagatgtctgtcgtagtaaattttatccaggaaagtatgcatcatctcaaagcacatgccagtctgatatatgtggtttctttacatctagtatttcttctacttgggagcacttaataatcaaagagggggccgggtgcagtgtggctcatgcctgtaatcccagcactttgggagtccaaggcaggtggatcatttaaggtcaggagttggcgaccagcctggccaacatggtgaaaccccatctctactaaaaatacaaaaattggctcacgcctgtaatcccagcactttgggaggctgaggcagacagatcacctgaggccaggagtttgagaccagcctgaccaacatagagaaaccccatctctactaaaaatacaaaattagctgggcgtggtggtacatgactgtaatcccagctactcaagaggctgaggcaggagaatcgcttgaacccaggaagtggaagttgcagtgagctgagatcgcgccattgcactccagcctgggcaacaagagtgaaactccatctcaaaaaaacaaacgaacaaacaaacaaaaaaattagccagacatggtggtgcgtgcctgtaatcccagctactgggaaggtgaggcaggggaattgcttgaaccctggaggcagaggttgcagtgagctgagatcgtgccactgcattccagcctgggcaacaaagtgagactctgtctcaaaaaaaaggaaaaaaaatgttaataatcatagcaggaactcaataaaatacacctttagaaaggtagattatgaatttcaaagatctaaaggaatagcaaaatgacagttgtatataagcacaaataaatgaaacaggaactgcgaatccaacgagcaatggctattcccaacagcaagaggaagaaattatgactcagtatgttatgcaaccaataggatcagatactattttcagtttcgtaccaggaaatgagccaggtatgacaaagaagataataatcctttgaaatgctcctaaaaatataattaaagcaaacaattaaacagtttgctattttaagagggaaaaaagcaactgtaaggcaggcccctggttcacttcagtagtctgtaggacctgcagcctacgataattagactcaagggactatgaaagtggggaaaattaaagtatctactttcgattctcagataaatacaacacataatgtaggttatttgatgcttctagaaaaatatgaacaatttgattattaaaggaaaatgttagtgtcagacgcatgatttttttttttgaaacggagtctcttgctctgtcgcccaggctagagtgcagtggcgcaatctcggctcactgcaagctcctcctcccgggttcacaccattctcctgcctcagtctcccgagtagctgggactactggtgcccgccactacgcccagctaattttttgtgtttttagtagagacagggtttcaccgtgttagccaggatggtctcaatctgacctcgtgatccacccgcctcggcctcccaaagtgctgggattacaggcgtaagccactgcgcccagccccacaggatttttaaatttggttttgcttgaagaatagtgttcctacagaaagcagtgaaatcaagcatttcaagggaaaggccctatgtagcattatgctggaagtctgaatactaaaatctttcaagaagaatagaaataaaatctaagttaactgaaaattacaataaatacctaattatctttcattttggctaaaactttaccttcatcctaatgtatattctcccattcccatcactgaggtttaaaaaaaatcacaataacaaaacaagccctgagtgaggcctgcaggctggctgggctgttgctccctggaggcccacaccagggtcattgctgcaaacataataccacaggtgagagatgggagttcaaagtgagaagtctcaggcaccacagaccttaaaaggaacacatatccaaaagccaaaagtaacagtatttaaatatgacacttcgattctagcactaggttaaaatctaaatgaaatggaaaaattctacaagttgttgtgaagaaaaactaacagatgaagagcagcaacattccttacagaaagggtcattataccaagaacaaattgctggaagctagcattccctctcacatgcttttttatacaagcctgtcatagtaatttcaggctgtatggattcacacagaaaagaggactaaatttacttttttactaggaaaaaaagagaaaaactgcctagaaacagcataaaataagtaatcaatcctcgatttagctaaaaccaaaggcatgtgggcaacatggaatagggtccaactcctccctaatactgcgagtgatgcagagtaagaccatgagtggcaacagcatgaggacagcctcactgcagtgctgcagattttatactcaatgatgaaggcagaaagtaccttccttaactcttaacagcaccttgtacctaaagcttataggaaatatataacacaaaatgacaagaaatttgggttccacatacaaaaagaacaagaaaaatgggatactaatattctcaaatcattaaataggttaagcactggtactttaaattattaattaacaaattagcattgtagaaagccgtctacaaaatgtttctaactaaagaattaagtaaaacagcttaatgaagtaaaaaagccaaaaaaacaaagtacactggtttcttgagctttcataagcaagtactggtggagagatataatttaaaacttgtgcaccaagtaacagaggtgtgagtaaatctaaaattatagtagtctccacttacgtgcagtttcactttttgaggtttcagttacccatggtcaactgcagtttgaaaatattacatggaaaaatttggaaaatttcagcaatacattattcatttggaaaaactcagcaatatattattttaataccatactaggatattatttcctttagcatctttaaaacaacatgatagaatgtttataaaacaatctgatctgatataaatcagatgacttccttagtcaattagaagagaacacctataatttctttaaaaagcaattcatatatacctatgtccaggaaaagttaaaaaaaaattcagttattagaaaggacgtattctttaatataactaagggtcaacaatataactacacatgagcttattctctactttattactaacacgacccaagccagaacatcacagacatagtctagtctgagttcagggatgttaaattggtatactatgcttatgctgacacttcacgtctcaacaaattagtaaactggtgaagtcctaaattcagtcactgcttccatcaaatatatgccacataccatgttgaatgatttaagtgaagctacagaatgcaactgtggggagttcaaatgtcaaatcctggctcaatgccaccactgttaccactgtgagccctgagaaaagttgcttaatttttctaagcctatcatttccccacctgccttcctacctttctatatatacgcttatgtatctagcaaatacttaaaaagtttttactatgtgtggccactgtcctaagaaccttacaaagattacttaaacttctatcagccttatgctgtaagaactcatgactttcaatttatagatgacacactgaggcacaaaggagttgctgttacttgcctggtacagtctgagcacaggctgtctggtttcagggttttgctcttaaccattactgcctatcactagttctcacaccccagatccccaacaccgtaagccatccttccatccttcccctaaggacttgtgaccacgtacccgagaaaagggaaatgctgaaactcaataggaagcccgacagcacactggctctgtgcgccactaattccttgagacctacggcaacaccacagttcactgggttcaactggggaaaccttgggaactggatgcaaagcaccagtcagctgactgtaatcgagttctgacttgagttttctctggaaacccccaaaacccacagtgtggcagtgccccccagtacacgactctataggctattaaaataaaaagggccaaccccagaatatttccttcctaccaaaattccaaatcaaaaaaccctccctaagggaaatgcacagatgacaggctggcagggaagtccatgcccattcagcaatcttatctggaaggttacacttactagtagaactgagtgatgacttctgttgattgctgttccacatttaacaaaactcttggcatttaaaatgctgcttaacatggtaaatgcagtcacttctatttctgataaaaagataacataccataagtagtttactttcacttggcaggaaaaaacctcaccattattgccttgcttcataaactctcaggctctgtaaccttgttatttagagtatggtttgtagaacagcaggattagcatcacctgtaagctttttataaatgtagactcccaggtcctatcgcagacccatctgaagcaggatctacatttttcacaatgcacatttttaacccaggtgatttatacacacaatacagtttgaggagctctggatacttaagctaatccacagggaacttgacagtctcaccatccataggataatatgctgatccactacattgaaaatgctactgaggaagcaacggccataacttgatccataaacgtaagggtagtgaaggctttacacacaaatgtctgtagcagctttatgtgtaacagcccaaaactgaacacaacccaaatgtctttcacgtagtacatctgggcaatggaatactactcatcaataaaaaagaactattgatcaaaaaaaagcgaatacatacaaaaattaatacatactgttgcattttcatgaaattcaaaaatatggaaattatagtgatacaagttcagtaattgcctgaggataagttgagggtagcagggaggggcaaaagaaagagacagcaaacggccatgaggaaatttctggaggtgatggacatattcattatcttgattgtggtgctgttttcacaagtcaaaagttaccaaattgtacactttaatatgggcaatttattttatgtcattacacctcaataaagctattttaaagaattatatgatctaattgatctgaaaatcataaagtcaacaaaagaaagtacactggtttcttgagctttcatgaacaagggctgatgcagagatataatttaaaatttgtacaccaagtaacagaggtgtaagtaaatctaaaattatagtagtctccccttacgtgcggtttcactttttgaggtttcagttacccatggtcaaccgcagttaaaaaatattacacggaaaagtccaaaaataaacaacatataagttttaaatgacacaccattctgagtagcatgacaaaatctcgcaccatcctgctccatcccttcttcaacacaataagggtgagtataatgcagtaaaatattttgagaacagactatattcatatgacttttattacagaatattgttgcaaattgttccgttttattcctagttattgttgctaatatcttactatgcctaatttacaaattaaacttcatcataggtgtgtatgtacaggaaaaaacagtatatacagggtttggtatcatctgtggtttcagacatccactaggggtcttggagtgcatcccctaataataaggggtcaactattgcataaagaaaacactaagaaaaaagggtgggagaagagaaaggtgggaaggaataatttaaaacaggaaatacacaaattctgtcattgttcaatagaactttctaaagaaacagtggatcaaatacactacgtaagtgtaataatgatgataaggtagtaccaaaatacaacgcttaacattattagaataaacccacacacagaacaaaccagagaagcacctaacatagttaagattatttttaaaatgtaaaattgccaaaatcagaagacaaagaaaagcataacgacaggcctaataccaaacacatcaatatatttaaagaagctgtatccatccactaagaaaaagattagccaggcatggtggactgagtagtcctagctactcaggagactggggcaggaggatcatttgagcccaggagttcaaggctacagtgagctatgactgtgccactgcacttcagcctgggcaagagagcgagacactgtctctaaaaacaagaaaactacatactgaactatgattcaaaaggagagggatgttaataactcataaaagaactgactcccagatgtttgttttcattctccaccattcttgatgagaggataaagaaaactaaaactaagatctgtaagtcaccatgcagaaaacaaagacagtaaagtgttctaccaattaatctttcacacaccataattcggcacttcaaatttctaataattacatcaaattaggaaaataaaaagtaaaatatatgctggattcaatctaataagctacattacatatttttagaaatctctttgaccctcaagcaaacaaaaaagacacagtgaacataaataaacaattcaggtcaacttggtggattgacaaaaaaattctgcaaactttgaaaatgttccttattaagcaattcttttttttttttttttgagacgcagtttcgctattgttacccaggctgaagtgcaatgccacaatcttggctcactgcaacctccgcctcccaggttcaagcgattctcctgcctcagccttccaaatagctggcattacaggtgcctaccatcatgcccggctaattttttgtacttttagcagcgatggggtttcaccctgttggccaggctggtctcgaactcctgacctcaggtgatccaccagcctcgacctcccaaagtgctgggattacaggcgtgagccacggcgcctggtcttaacttttatcttaaatgtattatgttaagaattgctggccaggcgtggtggctcatgcctgtaatcccagcactttgggaggcagaggtgggtggatcacctgaggtcaggagcaccaacccatgagggatccactcccatgactccaacacctcccaccaggccccacctccaacactggggattacaattcaacatgagatttgggtggtgccaaatacacaaactgtctcaaagacccagtagtcagttcttactgttcatcttacttggcctgtcaacagcatttaatcacactctccttcttgaaacattttcttcacttggcttttggaatactgttttcttcctaatgtggtatatatacaccatggaatactatgcagccataataaaagaatgaaaccacgtcttttgctgccccatggagctggaggtcattatccttagtgaaataactcggaaatagaaaatcaaatactgccatgttctcacttataagtggaagcaaaacaatgggtatacatgaacataaagatggaaataacagacactggggactccacaggggaggacagtggtgaagagggtgagaggtgaaaaattactgattgcatacaacattcactatttgggtgatgggttcactaggagcccaaactcaccattacacaatacatgcatgtaacaaacctgcacatgtatccccggatctaacataaaataagcacaaacaattaagaatattgttttcttcccaccttcctaccctgggtggcctttctcaatctaccgctttcattccagcctctaaatatcataatgcctcacagtcctcagacttttttttatctctacagtaaccccctaggtgtctcatccagtggtcatggcttcacatagcattaacattctgatgactcccaagttcacctgggtcaacctgcctcaactccgaattcatctgcacttggatgtccactaagcatcactaccttcacatatcaaacttgggactcctgagcgagaccttccatcccaatctagcaaaggatcagtcctaatttaccacaatagacattccaacaactgctccactcatgttcattctatcattctcagtcatgtcctaagagcagcaggagcttgggtagaaaagacagaggatcaaactcaggcaagttgagcagcattcttggaattttaggtagaggcagacaggaaagggattgcaagagaaggttcagcctgaagataagatgaaataattacagtatggctaacatgtttacaccaataagatataagccaatttgccctctcaatcaggtacctaccatgtgctcattactagacactaggtataagtgaagaaaaagccaactcatggttcttgcaatggggagatatggaaagtaccagatggtagagagaatccacattttctgattccacatcaagagatcaagatcaataaacttacaccaaaataattcaagagttcatcacattttaacaatgtataaaatctaaactgtctataacaaaataaaccatcctatggcattatctttgagaaaatgttaaactgagcagatcttgtgacctcctaagagtatcattacatgctgaaatataatggaacttcaagcttaggataaagatgacagaaagatagatcatgtggttaccaaaacattaaagaacactcatttatacaaagatagttaggctaggacagaagagtttgattccaatatcaaacctctgcagaagagaggccaagatgaaagtttgatatgtatgtgcatctattatactgtagtgggtctgttaattattagtgacttgttttgcattactttgagcctttcaataataaaattcaaatgtatcccaattctcaaactgaaagacatgctaacaaaaataaaatgagaagcactgcttgaaaagaggtttataccataaaacttacatcagatttttcacacagaattttttcattcagttatacaaagatattctttgtatttcaaagagagagcttttttcatagaaaaatgaatatggacagtagattttcaatcacatgaagaacagatccagagactgaaaatttccaaaattaaattatttctttctataaaaccttataaatgttaagaaaaaaattgttaaatacatgaattttgtcagctgtcccttttaacataattacctgtatttcaattcagctttgcatttacactgctaaattaaagcttttgcaattttatttcatcagagaaagaaaaagaagttatgaatgctggcattttaaaggattactgtggaagatcatttacaaaaacatgattgcctcacactaaattctgtaatctaaaattctaatgaaaacctattttaaatatttctttatcattaggtaacaattctttgatgtctcaacttgagagaactaggtctatccctttagagtttccacttagagaattctaaaaatgttttctatctcatcttgaaatatcatctaatttaaatgttactaagggcaagaatggccctcagtgaggtaattaacatgtccactccccatattctatactgctaatgtgcacaatatgggtcccaatagtgatgtcaacactgccaccacgaactactggaaggaaggtgcacaccaggaagccctagaaggaatggtaagaaacaacagctgttaatagatcctgataatttcattgctgtgtagccttgctgatgcctaatatttcaaaataatcagtttactgcttctaatccaggcaacctaaacttcaagagggaaggggacttgtaacaatgattaacattttagaaatctaaaaattcaccatttcctttgaatgaaacatctcaaaaatagtcacatgacttttttttttttttaaagaacaaaagaactcaattttattctaggattttactgtttaagaacagactttctaagatactaggaacaataaagtaaatttagtgactctgaatgaaatacagaactgctttctgatctctattttaataaaacagaagagctttcaaataagtcatgtctgtaagttgcttataaactctctttcattaaaaacacacagagtacaggaaatcacggttgccaaagagaaaatacatttgcctttcagatcccatcaattctccagttgtagaaaatgtgaatataacaggaggcaagaggggaaaatggtacccaacagacaagggtgaaccctgatttgtatcagtactaatactgccacaatttaaagatgcctatggttcaacagccagctcacaaaatttctgaacattaggctgggagtcatggctcatgcctgtaatcccagcactttaggaggccaaggtgggggtatcacttgaggccaggagttcaagaccagcctggccaacatggcgaaaccctgtctctaccaaaaaatacaaaatagccggcgtggtggctcacgcttgtagttctaactactcaagaggctgtggtggaagaattacttgaacgcaagaggtggaggctgcagtgagccgagatcgtgccactgcactccagcctgagcaacagagtgggaccctatcttttttttaaaacaaacaaaaaaaaattcctgaaaatttaacaatcacctggagtcagtgtgagcaggccccagtacaccactgccaaggcatttaattactggagggtctgtataggaagcaggcccgtaagtactgtcaaagacaaaaatctaacaaattgagttatagatccaattgccttttatttgtgattcatgaggcagggcagcctccattctacaaaatagaataaaagttcccatgaggcaatggcagaacagtgggttttaaagtaaggtagaaacaagaaaacaggacaagaggaaaaaaaactaattggttaacaggttacatcaggctttgcggggggggttgtttttttggcaagggttaaagcagagtagacttactgagctgattcaggtagactggaatctcctgctttcaggaaaaaccggtctgttttggaatccgtctgcttccttaataaagtttcaatttgattatgtggcattttgcaggagtgactatatcaatttaatctggtctgctggggatttgagcaggagctcagtccaaaacaatggcctcccataattttaacagtacaatgcaggatcctccaccatcagtatccatgaacatccactggccaagtcacttcctcccaagacaaaaataagcctagaagctcttctctcagaaaatgaacaaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaggcggagcttgcagtgagccgagattgcgccactgcagtccgcagtccggcctgggcgacaaagcgagactccgtctcaaaaaaaaaaaaaaaaaaaagaaaatgaacaaactttatgagaagaactagtgaaaagagagccagaaagaaagatggaggcctctgtgcagtatctggtccataaacgctcttttttttttttttttgagaccgagtttcactcttgtcgcccaggctggagtgcaaatggcacgatctcggctcattgcaacctccgcctcctaagttcaagtgatgctcgtgcctcagcctcctgagtagctgggattacaggcacgtgccaccacgcctggctaatttctgtacttcgagtagagatgggggttcaccatgttggcaaggctggtctcaaacttctgacctcaggtgatctgcccgcctcaggctcccaaagtgttaggactgcaggcatgagccactgtgcctgcccataaacgcattttgttagacatgcaaaaggatttttctctcccatcaaagagaaaaagtttcaagaaaagttttaatgtcaaaaaccttaaaagtagggggccaggaacagtggctcatgcctgtaatcccagcacttcaggaggccaaggcgggaggatcacttgagtcaaggagttcgaaaccagtctgggaaacatgacgaaacaacacaaaacttagccgggcatggtagagcccatccctgctactcgggaggctgaggtgggaggatcacttgagccccggaggtcgaggctacagacagctgagatcgcaccactgcactccagcctgggcgacacagggagaccctctctcaaagaaggaaaaaaaaaaaaaaaacaccttaaaaccaaaagcccaagagctatttttctagacatgtaaaatcttggcttcccttgaaaataatgagaaataaaaaaaaaaattctaagcccctcaaccaactgaactgaccttcttttggccaaggggaccacagagaaacctcagaggctgaattcgtagctatgatgtgatgggaggtcagaccatctccctcaatagccgccattaggctttcttctaacgggctaaagagaaaccagcccttgaaagatgccactgctgatttcaaccaacagcctgaatgctgccccgcccttctgccgttctgtcaaaacaaccaaccagcatttcttcctgataaagagactaccaaccacagggtggttctggcccatctacagaggaggcgcaatgagagtttttcgtgtcatctgcttcttcttttttgagacggagtctcactctgtcacccagactggagtgcagtggcatgatctcggctcactgcaacttccgcctcccaggttcaaacgattctcgtgcctcagcctccctaatagctggcactacaggctaggattacaggcgtgcgccaccacgtccagctaatttttgtatttttttagtagagacagggtttcaccacgttggccaggctggtctcgaactcctgacctcaggtgatctgcccgccttggcctcgaaaagtggtgggattacaggcatgagccaccgcgcccagccctctgtttcatcttttgacagcagaggtcccaagactccaccctcagatcctgctctggctgccatttgttacacatgggtcccacggaaaggcctgaagctcaaatgcgcatgtgcctgtttctcctttcataaatattcatgactcctcctgcagcttattgactatgtatacctggccaccctgctcagcatacattcctgttccctttaccccaccttccaagtggcagtttctggattctggccagaggctgtgcttcccagagtgtgggaatagccaccttgcaggctgtaaccctttatgagacataaagctctcctttctaaagttatgaaccttgtcattcttcagttgacagtaagaaagaaaaaaaaatacagtaaataagaaatgtccacaagtttcaagatagatgaatcttctaaaaattggtcttatttggcacatataaagaatatattcatatacatgtaataaagcataatcataataaactccaacacaatcaccactcaaagctagatctaggtcagaactaacacctgtctgccaccgagctcttcaactatccttccacctgaattccaaaccaaagataaccatccttgtaaagtctgtgtgtgtgtgtatatgttgattttattacacacttacacatccctaaacacaaactgtttagctttgaatgctattagttttataaaaaataagtcatactttcaaatcaacattgtgtttcaaagatttatccatattggtacatgtgtgtattattcatttatgtacactgctctctactatccaattgtataaatataccaaaatatttttccattctcctgtcatagaaatttggttgtttttcagctttttgctattaacaatgttaagtgtccctaggacacatgtgcaaaatgtctgcagaacaatgtggtttcaaatccaagtagcaacccattcatgagctagtcaagatgaggaattttttttaatgacacagggtagtatcaaactagagtgtacagacagaagaaccataacctttgatactctcccacccctatgtgtttactgggccagagtgtagatatatttcttactacaggtccaataaaaacagtctttaagttatccctctatgtaaataccccttaaaaagtgaactaccgagtcttatggaatgtggatattcaaatttgaaagacaatatcaaatacttttcctaagcagttacaccagttcagctcccattagaagtataaatcttcctgcctggtaatccacttaactcactaactcttagtaagacctggcttaagaatttttggctaatctggtggatgtaaaatggcatcccactgtggtcttaattgcaggtctatgactactactgtggctgaccatcttttcctatgtctaccctcactcctctacctctgtgtgaaatgtttttctgtcatgtcctcttgctgacttcaaggctgtacatatgtatgcatgtattgattcctgtatgtacttatcaatgcatacaagaatctttggccactatgtgtttcaaatattgtctcccagtctgtgtcttttctttctactttatttatagtatgttttcatgaattgatgttcttaagtttaatttggtaaaattgatcactgttttcttttatgtgtcatattttatgttttaagaaactcttctctctgttaagatcattgaagttttagtttccacttctaaacatattaagtctttgccattccccagcgatctgcaatgccacctctgtcacatatcaacttccccacttgggtggtcttttgggggttctatatttcaacccaatggtatacttatctatccgaaagcgaataatacaccgtcttcatttctatgtcattataataaatcttgagtgctgaaatggcaagacgcttcattttcttctttatgagtgtttggctatttgggggtctctttttgctcatcaagtccctcacaaaatcaatactgagagtctaggtgtaattacactgaattacaccatttgtgagaatcatctttttaatactcaatcttcctattcaagaggataatttgtctccatttatttttttaaacatgttacaataaagttttataatttctccaaatatgctacatgtagtcctagactcatttttgttcctactttccagggtatccttacttgacatcttttgtctgttgttggtataaagaaaggcaattgattattctgaatatggatctcatttccagccatcttgcaacactcttatttctaataatttattgtttcttttagctttttgatggagacagccataccacatgagaaggactctgttatttctttttcggtccttatttattgttgtttcctgcctactacagaaaccaggatttacagaataatatagaacagaggtggtgacagtgggtcctcttgccttgttcctgattttaggagatgacttctaatattttattgttaagaaagagatacctttcgtcaggctaaggaagtttccttctattcctagtttgctgagaacattttccatgaatacatgttgatatttctcaaatgctttttcctcaatctactgagatacacatatgactttattttcattggctaacatcatgagttaaaatttaatattttccagtggaaaccaccattgccttcctgggaaagcccaatttggtcttttgttacaatctgctggatttcatgtatgctcacaagtgaggctgtctcctcctattcctttcttccattgtttctctcggatttaggtataaagattacactagtctgaaataatgagttaggagtaaactctcactttactatcctgtggaactgtctgtataagattgtaagaatctgttccttatgcattgggtaaaacatcttaaaagtaaatctctatcatcaaaaaactgggtctggtgctttctctgtgaaaaagtttactataagaattggttgatcacttcagtgattatatgactgtaaccaagcagcttagcttcaaactgcttttagaaattttttttcctttcctcttttcatcccagtctcaagacacagctttgagacaaactacagatgtgttttcttttgtctctaaatacagccttggaatgtgctttaaaactccactcccctccctttcccaccttatgctttcatgcctgatgcacatgtatttacctggatgtttgttaagctcacaccatgctcacttatctggtcctatgtttccttagaagcttcaggggccaaatcctgatgcaaaccaggcacctccagaattctctcccgagcaggatattacttcaaggccagagttactcccggctagagactgacagcaagactgactgcgactgatttggcatggttgggcccaagatggtgctggccccttcaccagatggaacaataattcaggataagccataggagcaagtcatgccattgggcacctcccagcccccttgcctctcctgcattccaaatccctcttcttaaacccctgcactctccagaaattggaaagtggcagttttgggaaaggattctgtccactttcccccttgctggcaacaattaataaaattcacactctttatcatacctcactcttgttattttggcttctttctacaagcggcgagaagttggaccctcttttggttacatgactattccagcccatgatttcttcttgagacagaagtttcatatttattggcataaagttttttcccagtattttcttattatctttataatctctcctgtatctataatcacacctttttttcatttgtaatacgtattgttaaaacactttttactccactgtaaagagcacggccttgtgttgaccctaggcactgcatctctgtcttccattttactcatttctgttccttgtattgttgctttagttcaacattctttgaacttaaaacttttaaaaatctttttaaggtaatgcttagctatttatcatcaatgacatctccttgctaacttatggatttaatgttgtaaattcccctcaagtactgttacagtaggtagctaatcagacacgagcagagttggaaagggctccccacaaaatacacacaccaggaatgtcaggtgaccatgtaattgtcaggcggctgttaactgtctctctaaaataataattggtcacagccaacaccagagaaaggcagtctcctcgaaatatcaggtatttccagatagaaatacctgaaactggtgatcagcagcttcctgataagatctcaggagctgggcaagtgcagttgagcatgagcactgaggcaaaatggcggatgacgtccctctaggaacacggggctgcaaagtgggaaggtgcctcaagtaggcaggcctgcaacttagtaaacacactgcacgtgcagcccctcccaagggctggcaggccactgcgcatgcagacagcccaccccaagggaagaatcacaggagaagcaacagaagaccccagaagaatgccaacatataaaaccccaattcaaaaggtcaaacggtgcgcctgatctctcaagtcgtctacttgatccttgtgcaagttcctctccttcctgctctagagctctttaacaaactttcactcctgctctaaaacttgccccagtgtctcctccagccttatgcccctgggtcgaattctttcttctgaggaggcaagaactgagattgctacagacctgtacagattcactgatgctaacatacttgtgctgcatgacatggatacatcacagctaacagtaccactttaatcaaatctcatatatttggacatatggtaattgtataatcattcagttttagtattcttttccattatagtttcttctttgacccatgagctgttcagtattctcagtttacaaatatacggttttagaatctgtacgtatgcatatcttgtttctaactgttaaagcaaactaaatacggccttagaaagactctgtacttctatacttgtggatgaactgcaacctaacttaataggtagaaaagacagaaaacctaacttaggagtatgccctgtgacagtacctgaggcttggccaatcccagcagccatacttcaaccactcatacactgcccagtgttcaaactgtgttaaaataagacaaacgctgagctgtaaccaatccagctgtttctgcacctcgcttctgatttctgtatgtcacttccttcttttttgtctataaatttgttctgaccacaaggcatccctggagtctctctgaatgtactgtgattctggggactgcccgattcataaatcgttcactggtctattaaactcctttaaacttaatttggctgaagtttttcttttaacataacttaattccaccgtggacagaaaatatggtctctatacaccaattttctgaaatttaacagagaccttagggtcctgcacgtgacccatatctttaaacatttcttgtgttcatgagaatacataagttggggttgagtctattaaaccaaacttgataattatgttgttcaaatcactaaaaaatttttattaacttttgtctttttgacctcatggtaaattgagggagatgggttgataattttgtcagtgatgacaaattaccaatttatccatatcattttatgtgtgtatcttgagacttttgtttttaagtgcatacaagtttaagggtatgtttcttgaaaaattgaatcttttatcacatgcagcaactctctctctagtaatgctttttattttgaaatgtattttgaccaatatcaatactgatatatctttttttggctagtaatcttcaggtacaaaaagaggtatcccagatgtggctatttttaacaatattcagctgatgtcaattatttagtcaaatctgaacatctatgtctttaaaccgcaagtttaatcaactaacattaatagtgagtacttgacttatttcaacatcttactattcaagatgttctaagtttatgctattttttctctttacatttttttaagattggatgaacttatctttggtttttgttttgttttttcttgaactgttttgttttgttttctttgaattttatcaagaatacaaaacccccagatgcaatattttaaactccctatcaaagcgaagaccttaaaattaaaagctttatgactccaaaaagcaaaacccaatgacaaaggtataagccaagcatgcatcaagttgttcaaattagaactgaagtgagatttcttgaataaatatagaggaattaactccaaacaacaggaaaaatgaagataggagacaaatgacattcaaagaaaaatcagacccactgcctgttttagtacaaacctgtgagctaagaatggtttttacatttttaaatgcctggggaaaaaaatcaaaataaaaaattgtttcaaaatgcataaaaatcaaatgaaattcaaatttgggtatgcataaataaagctgtattggaacagagccacacacatttgttgatacatcatctatggttgctttcatactataaagtcagagttgtatagctgcaacagagaccatatggcaccataaaacctacaatatttactatatgacccttcaagataaagcctgcctgcctgtgatttttaacatattaaatgagtggattctattaagatactattaagatacttagtttccatatgtccttcaaaatgtctggaatcatcacagtaagtctactgtaatgttataataaaaagtatcattaataaatatggaggaactcccaagaaaaaatggagataagaactagcccagaaaagaaaagctatagctacaatcacaaaaaagaaaatgacattgcaaagacagaaagagttccagaaaaatcccaatttcagaatccacagaacagaaagacactctggaacaaacatcaaggtaatttgaacaatgaaaccaatcttagccacccccttgcatatatataaacttacaggtagcatcaacttttacttctaaaatcaagctctctgaccaacttctaaacaaagttcatgctctgtgtcagaaggtacataaacatgaggctgaagctggggagagaagcagggcctaaaacaataccagcacagaatgagaagaggcagaatagacagctaagccaaagacattatagaaatcaaaacacgtattttttaaattttaattctaagaaagtgagaaaacagtaacaaaaccacagaagatgcaaaaaggtgtcaaatggtcaaattctacaattctttcaagtaaaatgatttgttctgtatatagcatagaaaaacatggaaagcttttcacctcattctatgaagacaaataaccttcacaccaaaccaaaaaagaataacacaaaacaaaattaaaagctcaatctcctttatgattctaccaaaagcattttattgaatccagcaatatattttaaaaaccaacaccacccctaaccacaatgaccagacagagcttattctagtaatgtatggccaccgcagcattagtaaatctattaacacaactcagtataataaaggctaaataaggcaaacgctaacatacatcaattataatcccgatgcatattttaaaagcatttgacaaactttaatacttattcttgattaaaaacagaaataatctcctaacaagttgaaatagaagagaactgcctgaatatcataattactggcaaaatattaaaggcacccaccaaagtcaaagaaagataaggatgatcacgctcaccttaacaaatgaatactctatgagggcctgaaccaatatgaaaaaatatgaatatgtaaggttaaaatgttgggggaggagataaaaactgcattacttataggtaattacctatattgtacttttcaactgaaaacacaagaaaattaaagaagaattaacacaagtaattatccagctgacatgatataaaataagcacataaaagttattaacttttggccaggtgtggtggctcccacctgtaatcccagcactttgggaggctaaggcaggtggatcacgaggtcaagagatcaagaccatcctggccaacatggtgaaaccccatctctactaaaaatacaaaaattagctgggcatggtcatacgtgcctgtagtctcagctacttgagaggctgaggcaggagaattgcttgaacctgggatgcggaggttgcagtgagctgagatcgtgccactgcactccagcctggtgatagagcgagactccggctcaaaaaaaaaaaaaaacttaataactttcctacagactataataacaagactacaacgaaaacaaggggagggtctcattcaaaggaataaatgctataaaatagctaggaatatatttgagggggaaaaaaagatataagaccaagaaaagtataaaacttccttgaaagacattaaaaaaatgaatgaccccagaaaatacgagccatgcacactatggatagaaagatttactatcataaaaatgtcaaaattttcttaacaaaatttataaaattccaatcacagttgcaatacagaaatttttcctctttgccttaaaaaaataattctaaattcatttggaaaaactgatgtgcgagaatcaacagagaaaaccttcaaggaaaaagaataataaagagaacctagcatcatctagatattaaaagttttaaatttaaagatactggaatcaaattaagcacattagaggacaatatctataacacatttaaacacaaagaatataaaaatgccttttaaataaacaagtagttattaaataatcctataaaaggaggatgaagatgtgaaaggcaatttacaaatgaagaaaaggctgagtaatgtggctcatgcatgtaatcccaacactgtgggaagacgagggaggaggatcgcttgaggcaggagttcaagatcagccagggcatcacagtgagacccccatctctacaagaaaattaaaaatcagccaggcctgatggttcacacctgtagtcctaaccacttaggaggctgaggcaggaggatctcttgagcccaggagttggaggttacagtgagctattatcatgccactgcattccagcctgggtgataaagtgagaccctgtctctagaaaaaatcaaaaattaaaaaaaaaaaaaaactaaaaccaaataaaaaaaaaaaaagaaagccaaatctcatttgaaaagataaaacatcacataagcatttggggcaatacaaattaaaatgttgagtttttttttttttaacctaggcaaacttcaaaaatagcaacattatatgctggcaggaatgtgaggaaacatatactgtctttaaccgatgggaatataattttgtagaatttattaatactaaaatataaaatgaacaaatgataactggaacagcgattccctgtttaagaatctatgcttatgtacaagggtattcactaccttattataaataacataaacagaggaaaaaaatgttcattaatgaagaaataatataaaattttggataagactggattaatatacagcagtaaattaaaaataaaataaattgatagttactgtaagtcttaaaaaagtatgatcctgtatatttaaaaaacaaaggaatcccaaacgtatgtttgcatgtatatagttaaatatagatattgtaagtcaaaggcttatggcaaattattattgttgtctaataaataaataccttcatattttatcatacataagacatctgtaattattaaatattttacataatttttcaaattaaatatattaagtgtcacgttaaacagctataggtcatgattatctaattatataaatatttaaccaatgcttatatataatgtgtaactttttaaatgtgacatttaagaaccccttcggcatgctgaaagaagaacttaatagtgcttaccaatatcgttaatcactgctcttattttggagacaaaaggaccaacttcactggaactcattttggctctttccttaaggtcagcacctgcaaagtattttatttacaaatataatctagttgtaaacaaaattttaaggcaaagaattgaaaatttacttaagattagtatacaacttcaagatcagcctaattcatcttttaatagaatgacattacctcagttttccttcccaatgaccatgttcaacaagaataaagtatttgtctattcatacgtctaccatgtgcttaaagcggtgcttctccagctttccagtctcaggccccttcacgctcttaaaggaagacactatagttggcatctactgatctatagttactctattagaaatcaaaactaagaaattgtttaaatgtttattcatttaaaaatacaaatgaacccattaatgttaacataaataatgacaaattggtgacaccaccttgctgctttgcaaggtgctgtcagtttatccaccactgcttttgcagtgtattagcacaaatgccaacccagtaaaaagggcagattacactttggtcagtccttttgacttcatggatgcctgccttggggactgtcaaccacaagggagaagcatagatttaaagtatgaacaaactgatgatttcataattatgactttagcacagaatcgtaactttggaacagagaaaaataaacacatggaattccttaagggataattaactctgagaacaaagaagatctttagcaaaattaacaatctgaaaaaagatgggtccccaattaaacaaacagacgaacaacaaagtaaaattacagtatagaaggcatacactcagctatttacccttattagtctattacaaatcaatcatgctgatacataatataagtaagggctagggcaggggcattctgatctcacacacttccaggggagtgagaacctcagttgacaaagcacatatcccagcatccatcagatcttagatatgtataccctagaaaatctctcaaatacccaagaaaatatgtacaataaaattcaagggagcatacaaagactagcaaaaaaatggatataacctaaatatccatccataggagaattaataaaacaaggacataattataaatagaatgttacctgtataagcatgaaggtgaaagaattaagagtaaatacagataaatccaatgaataatattattgaaaaagtattaattacagaaagatacacaggataatgaacacaaattttaaaaacaataatgctattcagggatataaaacacacagaaatgataaattcaattggtggttatgggggctggagtatgactggcaatgggtacacagaggacttcaattttatttgtaatattgtattgcttaggttgggtggtgggtgctaaatatgcaagtctttaaatgttttggaatgcctgatacatgtctttgtaattaatttttccatgaagaattaatatgtaacaaagaaaaatgttggcagaaccaaaaacaaataactggcttaacttggtgccaaactgttctttgaggcccagtatttctcagttccattacttcataaatttaaatattttacatttatgaccactcatctcaagtgggccattctgctgcccagcaatcctactgtatttcctgagttcattcactctcctactcacatatagaccacttcacaacttccctctccacgaatcttaaaacctcctatcaatcctacgaaaagccagaaaagacattctaccagtacttaccaccaaagctatccatccaggacttgaacctatatactccgccctgcctcctgttaccatgaatgaactaactcattgagagtgacagaagacagacaaattccccagcagacagggatgtgtccccagtgaaacccaaccttcaagccactgacagtttaaagtctaaaaaccgagctgctggtttgagagagtccataaacagagagagaacttctatccccatattaccctcactctcttgattggttccttctggatgatgccttttaaccaatcaaacagtgatttttccaagcccacccagggatgaatcagcacacacacctccattctaacccataaaaaccccagactcaccctctcaggtggctacccactttgggtcccctctcacagctgagagctttccttatgtcactcaataaaattcttctctgccttactcactctctggtgtccacgcacctcattcctcttggtcgcgggacaaggacctggaactcgctgagctgcaggcgacaggaatgaaagggctgtgatgcccctggccggctcgccaagctgcgtgcaacgggaataaaagagctgtaacatgctcccgctagccaagctatgggagtgaagagctgcaacatttctggggtcccagacctcaggactccccgagcaagagttgtaacactgcttggggctccatgaatgctggttttatctctgagtttttgggtgacaccacattccccttgtctagacaccggtgcctgacatggaagtcattcatggcatgcccagtccagcctcaagctgagtgtggaggtgcagcaggcacgggattcaagtgggcgcgaaccaagcacaacctgccaggccaagagggtggagtaaggccagggggcccaagcaaggcccagacagaggtggcaggggcagcaaagatttctggctggcaaagtggcactgaaggaatcctgtaacatcatgagggaggccaatccatccccttgtgcactggattcaaccccttctaatctccttggggacatcactcactccagcacttacgcgctctccttggctggcatcaatactacccctccttagaggttcgttcccatcagcatatagcaatgctgtaatactgacatcttaaaaaaaactcacatagacttccactgttagctatgatggaataggtcatcatcagaccaattcctccatgaaatactgcagaaaatatgtaagacagctgcttgagcaactaaggcagccaggatgtaagaggctggaaagccagagaagggaaactatggtaagcctctgctttcctcccaaaacatacactgagttataaactggtcgggtaaagagggtataaaagccgtagcacgaagcagcagctcagaaatctctgtaatctcctggaagtggggagacaaacactggcagtgaagactacaggctcagccagaactttgaggccaagatctcggagaaaaaggaactaccaacaagagagcccactaaagggactcaccaaattaatgaaataaaggtgaaaatcgtatacattttcattagttacagaaaaagtatttgataaaattcaatattcattccttaacatcttcactgaagaataatttacataaaatagagttcagccactttaagtatagaattcaaggatttttactaaatttacagagttgtacaaccatcacctcaatctgatcttagaacacctccattatcacaaaaagatctctcatgcccatatgcagttgctccctgtttccatcccagcaccatgtaatcactaatctatgttcctaagaattggtcttttctggacatttcctataaataaattcatacaatatgtggtctttttttgtctgttttctttcatatggcttgcttttcaggttcatgcatgttataagcatgaagtattccactgtatgaacatataaacgttttgcttatcccttcatcggatgacagatattcatatcattcctactttttggctactatgactaatgctgatatggacattcacttacaagtttttggtggacaaatgttttcatttgtcttggataaagacaaagtagaattgctaggtcatactgtaaatttttgtttaacttggagaaaagaaaaaaaaaaaacaaaaaccctgccaagctgtttgcctaggttggctgcaccatttcacattcctaccagcaatgcatgagggtctctgttttcctagtcaccaacaattgtctgtcttttttattatacccattctagtgagtgtgaagtggtacctataaggattttaatttgcatttccctaatgactaatgaggttaaacacttttcatgtgcttactggccattcaaacagctgctctagtgaaatgtccattcaaatcttgctcatttttttaaaatcaggtaatttgttttctccttattgagttgtaagttataacttagatacaagccctttctaaaatatatgatttacaaatattttcttcatttttgtgtcttgcctttcactttcttggtgatttttgaagcacaaattttaattttgattaaaattaatcaaaattataaatttttatcagttgtgcttttctggtaatatctaaaaatcaacactcattcctgattaaattatcttagcaaattaggaagaaaagggaatctttataataaaaagtaactgtaaagtacctatagctaacataatctttaacagtcaattactaaaagcttcctcccagggaccaagaaaagagacaagggtgttccctaacacttttaaacactgtaacagatgtactagcgagtgtgataagaccaaaataaaacttacaaggattgaaaggtataataaaacagtcattattagcagataactgtatatgaagaatagcctaaagaattttcaaaccatgaaaataagtaaatttagtaaggttgctggatataagctcaatatacaaaaatcaactgtatttctatatactagcaaaagaaatttgaatgtgaaatctcgaaaagatatcactttcaaaacatccaaaaatcaaggagtgaaagaataaatctaacaaaaggaacataagaccttgacacaaaaactgaaaaatcttactgaaataaagaagccccaaataaaagaacacattacattcatgtgttagaatagttcatactaaaagatgtaaattctctccaaattaatagattaaatgttgttccaataaaaatcccaatttttctgaaaattaataagatgaaaatgcaaagtgccaacaacagtcaagataccgcataaagtattggtgaaggtgtaaagcaatgagacctctgacttaagactgctaggagtaaaaccagtacaatcattttggaaagcaattccactccaaatatacacactcaacaaaaaatgcatgatgtgtactaaaagacatgtacaagcatagtcagggcagcactattagaaacagctaaaagctgggaacacctcaaacaacaagcaaacagtagaagacacaaattatgaaatatttctacaaggaacaggactgcactactcctagacgaatggtacaggctgaatcctgcaaatatgttcaatggaagagatcagcctgcaaaattccaactacataaagtttgaaaataggcaatattagtatttggcgataaaagtcataataattgcctatgtcttttgggtgggagatgggtaatgataaggaagggacatgtgggacgactgtggtgtgctgggacttcattttgtagaaatttacagaattatgtgcttttaatttgtgcaattttctgtatgtccacattatacttcagttaaaattttttttaagtttcctgattccatacgccctaccccctccagctgccaattttttcctcctttttacgccaaactcttcagaagacctgcctcccatgctctcctcctatactgtctccaagcaagggagacaaaaagagtaaaaaataaacataacaaattagtaatctacatagaaggggataaatgttttggagaaaaaggtgaagaaagtacagacgggtattaaaggtggtgaccatgtcacaatattcgatgtcataaataccattctatttgagaatgtataataagctttgtgaatggcagtatcatagccaatgaggtttatctgaggagagattattctaagagaaagtataataagattcaataagatttcatatgttccttgtatttcaagtgtatctaataatttaatacctggttctcagacattttaaatgaactttatatctcctgttacatatttgtatgtaacttgccagtaataacttgtattgcttttgcattatctactgcaaactcttttcatttaaatatatagttggaaatgtataatacactaagtagacaacgcatggaattgatacattatttaacaattttgagaaaacatatattttaaacaccacccactataatggccctctcctaaaatttcagtgttttaataaattccttcttttaaatattctttaggattagtatgtattaaatttctatacttatatttgcagtaaactactccaatgaactttagagaagttatgggaaaacacactattctctgttatgcactgcatgatgtctagcttccttggcccccactaaccatatgtcaataaagctcttcaacagccaaaaacgtccctcaaattccaaaaggctccacagtgggtgttaacgtccccttgagatctaatgctttaagccagtgatcttcaacctttttgttcctattattgctaaaagaattttgaagtatgtgctcctttgaacatttttatgctgacatttgaaatttttcatctaagtttaagtagtttgaaagatttcaatgtactatgaacactcacatttttaaacaaaactcatatgccattttcaatgaatccagtggaacctacactatcagtgatttggttctcaaaatcatccgcattaaaacataccgcatttaaaacaagctgggcgcggtggctcacgcctggaatcacagcactgtaggaggctgaggcaggcagatcacttgaggtcaggaattcaagaccagcctggccaaaatggcgacaccccgactctactaaaaacacaaaaattagccaggagtggtggcgggtgcctgtaatctcggctacttgggaggctgaggcaggaaaatcacttgaatccaggaggtggaagttgcagtgagccaaaatcgcaccactgcactccagcctgggcaacagagcaagactgtctcaaaaaaataaataaaacatacaaacaaacctatccttaaaaagtgtaaactgaagaatgaggaggttcataaacttggaaaggagagttttatttctcataaatggttgcggcttgtgccatactgacaggctggggagcacagcttttggccagaagccagaaacagacacttcaagggaaaggcaaagggaagtggaatttatgatgaacgaggtggctgaatatacatatttaacaagttctaagagtcatgaatattataaaaggagaaatgcgtgcgcacaattgagcttcatgcactttcatgggtcatgtacaaaaaatgggggcgtgagcatggcccgagggcagagttttcagccctctgctgtcaaaggtgaagcagaggacacaaaaaccctcactgtgcatccttcgtagacctcccagaaccactctgcggttctcgctctcttatcaggaaagaacgctggtaagcagttaaaactacaaaaggcaggggcagcaccaggcagtagatatcagcagtggagcaagtctttccaaagggctggtttgtttaaccttcaggaaagaaagcctaatggcagttctccagggagggggtattacaagagatgtccgacctcccatcctgtcatggctgagattttcctcggccaaaaggaggtcacagttgtccaagtcagttggcttagcatttcatttttatttctcaatataaaaaatgttacattatctcctttcttcattaactggtatttttgctctgctttcaattttttttttcctgatataactggtatttgtgctttaaaatattttatttgtcattctgtcacatttctttgcaacaaaatgtgtatgcaaattaaattaatttttattaaattccctataaagtgccaagtttaaaagttttcttctggattgaattttcattacaagtattattagcacagaactgacaaaagcaaaaatatatttcaaatttgataactattaaatactaaatataaacttttattagacatgcatcacaatgagatagatgggactaccttccctcctctcattatttcatatattcatgaatgagtattatttactgctagagtgaggcaggatttaccatcaattttactcatgctgagaaaaccttttcacataaacaaggaagatgtttactacagcaatgtcattcctttagcactctggtgaaaaaatcacatcgtaatcaagaaacatctaacaagttcccaacaattctagtaaactgtcttcaaactatgttgaaagcaaagaaccagaaactgccagaataagaatctcagctgaaattctcaacattaatattttaaaggcctcttttttggcaattcataggcttttttcccctccctgtagcaacaaagcaaagatcaggaataactttccattgtggaagaggcaactatgaagagaaagagaactggaacctccagttcagcctgaagagttttatgacagggtacacgttatgtattagacagaccctttatgtattagacagatgtgtgcacctcctgaggcctagaaacatcccagccccagccaggggatctctgtttttaagtcacatcagtcagaagtcagttgccaggtcatatggaatgcaaagtggctgcacatccacacactgcctccagtacacggcattgtcatacttgctgtgatgactcactttatgtgtctacttgtctgggccacagggtgcccagataaaatacagtttcttggtacgtcagtaagggtccttctggatgactagcatttgaattcgtgaactgcaaagaagcagcccttcccatgtgggtagccatcatccaattccctgagggcctcaatagaacaaaaggtgaaggaggaaggaactggcctctattttccgccccactgctagagttgggacatctcatctcatcttcccctgcccttggactagatttacactggctcccatgaatctcaggcctttggacgcagactgaattacaccaccagctttcctgggtctccagcttgcagatgtagactgtgggacatttcagttccataatcccgtgagccaattcctcacaataaatcttttatatttctattgatactatttatctggagaaccctaatacacttattaaattgtggcaatctagtgaatgagaaatggtaattttaagttgcatttttctcagaagtaaaagatgaaatgcttcacaaaattgtagggggttattacgcagtgattaaagtcatgatttcaatcgttccaatttttgtacatgtggtgccaattcgaacaccctggtctcttgatcccactccaaacaggcttttattctctccaataaagccaaataatcaggtcaagataaccaatgatttccatgtggctaaatccacatcttaacctgcaagcaaatctggataaagcggggattctcctgagtcctggaatatctccaactaggaccaggaaactagtctgtttttctttcccgctgctcttacgtggtggttgtcaggggtaccctagcttcataaaatgagctggaaaagactctctttttctattttctcaaagagtatataaagactggaattatctgctccatgaatgcttaggtgtaaatgtaacattcttctgaagtcattgtggcccggtgctttctgtgtggaaagatctttaactgatgcttcaatttccacattgctctggtattactagttttctatttcttaagtcagttttggttaatttttattttctagtaatttatctattccacctaaaatcttgactttattgcacattcttaacattatcttaccagtttaatctctgtggaatttatatctatggctcccttttccaatctgaatattgtgtattttttccctcactcacaattaatcttgccaaaagtctgactatttggcttttcaaagaagcagctctaggctctattatccttactacttaatgtgttttccatgtcattagtttatgctcacttcatttcctttcatctaccctatttgggttattctgcagttattttttcacttaaggtacatgcttagtttattcattttcagccttttttctttcctgaagtccaaccttagctatcttatacaatttttaaagtattttttgttagcatttagttctgaatgctttctaatttccattaagattcatttgctgagctgtaagttatttagaagttatcttaaatttcccaatgtaggggactttttctaattacgttttttgttaatgacttctaacaactgcctgtggtgacagaatgtggtctgatgatagctgtcctctgaaatctgtggaggttttatggcctagcagatggctaattttcataaatagtccatgtgtgcctgaaacgaatgcctagccatcaaccactgtggatgaatgtccacaaaggtatattacattaaccctcagtagaccaggaaaagtaaccaacactctatcagctggggccaatggactccttagatctttatttcatatttaggtcaatttacaaacaatttaaagaaaaataatagtgaaaaaacaactttattagaaattttagtaaaaatttaaacataaaaaacccacgttgctattttatattttcctggcatatgcatatatatgtatatacacacacatacatacaaacacatacatattataaatatacaaatatatactcacatacatacacaaacacatctgaaaaaggctacatcatttgaacgaaattgttaacagacagaaataaacctggattggccaggcatggtggctcatgcctactcccaacactttgggaggccaaggcgggtgaatcacttgaggccacgagtttgagaccagtctggctaacatggcaaaaccctgtctctactaaaaacacaaaaataagctgggcgtgatggtgcacacctgtaaacctagctactcaggaggctgaggcacgagaatcacttgaacctgggatgcggaggttgcagtgagccgtgattgcaccactgtactgcactccagcctgggtgacagagcaagactcggtctccaaaaaaaaaaaagaaatgaacctccatcacacagactcggtctccagaaaaagaaaaaaaaaaaaagaaagaaaaaagaaatgaacctggattgcacaggtttataaaagctgaatctaggtttcaaatacatctctagcagatcatcattactatcactacttctggttcttcttggacttgcactgtagaaatgcaatgtttttgaaaacactgatggctcttaatttaaagaggacagccatattctttgctccctaattgcaatatactttcatttttagatttataaacatcagtcagaatgatcaagccaatgacttgttttcatttctatgccatctatttccttcttatcacctttgtatacacaagggccttcaacacatcatttacaagctgtatcaagtaaatgttcacatataaacatcatatgagatccaacaatactatcgcacatcctcttggcaaaatgggatggtccctccccactgcccacagagcagagattatttctctgttatttactgctatatcctcaacagtacctgacacatggcaggctctctctaaaaaatattaaatacatgaattaattaatgaaattcatgtgttttctttgtagttgagatctgatgaagagttacagtaaaaatgcttaagaggtatgaatactaaccatttaccttaacatcctctccaacttacctcctcctatttcctgatggcagccttttgttctggtgccctcccaactccccacagtccatatactttggaagaagatgaatctacccccacatccaggagtggactatggttagtttgagctaaccagcatggtccactcccctaagcaatcaaatcaagctcaattgaagggctccagcttggattgcagcagagtattctctttctttcaagaaagtcatgcatggatatggggcccagaactgaagttttaggccaccaacccatatataaagctggcaaacagagtaaactacaggaatttcagaaaaattcaaaatgactggattcaggcaatcctaacaggcttatagtttaagtcaatttgtgaaaatgctttgttagatggaggtgagagctcattatctaactagatgacatattagaaatgattacaaattggttctgcttcagtccacatctgttctcaagggaaggaattgattggtggagatataaaattagctctaatgattacagaaagtttctaggtaatgtctggagaggatcaagtgagattaaggagcatgaccttcttggtataacatgactactgtcagagcttctagagcactagatcctcaataagaataccaacttgtaagtgctttcacttatatcctcatccagaacctgcacccaccttttactccaattaaataaaaaatttctatcttggaaactcaaccagtaaaattttacctgcccatttgatgaaaaggactattctgccacaggatttctattagaattcaaggctctaataaatcagatgtcacttttcctcaaagtgaagtgtcctttcactaaccaaaaccaaaaccctccatttctgtccagcgtctcagcccctcttgaaggcctacttcgaggcttctttctgaaacgtgatgacacctctccctcttcaataggatcagattagtttcatcagcatgcaaactatagtaacacctccatcctgaaaaagtctcatagatccctcatacacttccagccatcactacattttaatgaactaacagagactgatttctaggaggtactttttttttggcagggggacagagtctcgctgttgttggcctaggctggagcgcaatggcgcgatctcggctcactgcaacatccacctcccaggttccagcaattctcctgcctcagcctcccgagtagctgagattacaggtgcccaccaccacgccctgctaatttttgtatttttagtagagatgaggtttcatcatgttggccaggctggtctcgaactcctgacctcaggtgatccacccacctgggcctcccaaagtgctgggaagaggtattgttaactgcaaaaactcaagtgcaagaatatatataaaatgctactagcataagaaagattggaaatagttgaacaaataggtatagccttaattttgcagacagaaacatgaaggataatctagaaactaatgagactcactaacaccctcaagggtgggaactggagggaagagattagagggaggaagtgggtactgacacttctatgattatatctctttgaatagtttagacttctgaaaccatattaatatttcatatatcaaaataaaataaataggagtgaggaaacctaacattacctctaatgaataaaacacaaccacaataaagaaataacctaagtaactcttcacacaatatgtttagtattgtatattacagtattacataccttcagtccaaagatataaagtacagctactccttgacttgcaatggggttatatcccaataaactcatgggatgttgaaaatatcacaactggaaaatgcattttacagatgctcctcaacttaaaatggggttacaatttctactgaatgcgtatcacttttgcaccatcgtaaattgaaaaatcgctaagtcaaaccatcattaagtgagggactgtactgtcaataggtaataagctctggataaaaggtatgtttaccacagtggtatggatcagcaactctgaaattactttcagtaagttacaggattgagcaaatgagtcaatatactgcaggtactacaaatatggaaagggagaaggtaacaatgaaccctgtggtgataaactggaaatggaggtaacaatataaactcatggttttcaacatgtaagtacagaaatggttgtaaacatgtgtgtgtgaatatgtaatgtaatttatctacttatttcttaggtctgtcttgagaagcaaagacacccatgtaacagtgagcacatgttgtacccagatcttggttcttcaataccattccccactaataggaactaagaacttgcacctgtggctgcaatggagtaactggtactggatcccctccctcaaaatatatgaaatggctcagctattgatcaacaggcagtaaaagactaccatctgggatcctgtgactgtccctgttttcttcctgaagacacctgacagactggtagaaggcaggggtaccccaacaaagcactgtggtcttgctgatcgagatcagcgtgcagggaggctgaggtggctggaatttacagggcagataaatggaaaggtggggtaacctctcagaggaagagctccagtaaaatgcactagggttccctaatgcttaggctgaacagtaaactcccaattcatagaaaattactagagaaagaaaaaacaaccagggagctatgaaatgaacaaatcctagagattacactgagctgaaaggcattcacgctatgaccagcaggaatagagagaacttgtcaacacctatgtccagctggactgatcctccaggacagtaactaccttctgcagcaaaaccacactgaataagaaagatacctaataggcatgtgtcctatctgtcacaaaacaaaaccaattgacagttatttcacataattctaaagaaaaaaaattaccaaatgtttacagtcacaaaaaggtaacaaacataatatccattaatataaaatttaatgagtaaataatactggtattaatcatgttgcctttttctttagagaatgtaaaaatattgactacctccatctctttcaaccttattttaccccgaaaagcaatacattattcaaatgaaacttcaactcagggagtttttaagaaccataaacctcaagatcatcctaattggtgctggccttcaaatctagcattcacccaaatgacactatcactgaacaaaatacttctcaaactatgagttgtacaactgtttccagatcactcaccaagcacacaagaaaaaatgaacatttttatttttatgtcaagaaaaacagcctccatggccaagcctctccagcttcttcctgcaaagcccagtgtaactgacccctgctcctccagctggaacaaacagagaaaactggagtgtgaaccagaagacagcaaaaaacagcctgcaggccagtctgcacccagcttttacatcttttctaagggttgtaaagataaaacaaagaatatgtgacaaaaattgttaagaggcacacaaagcctaaaatatctggccttttacacacaaaatttactaacctcagtctagactaatgccagttcccagagaaagccctgagaaggcaaactactactgagtatcaatttccagaagcagactgacaaaaatctaattttttctaacttttgaagtctccctttctaactgccggagctctactcaagctgaccaaagttctagagctgaattccactcccctggcctcatgcaagaggggtctcctgcaggaaggaccccttccagcctcccactgcccacaatgctcacctcaccacataactgggcagccttggagaaaggggactgagagaaccacctaggctctctgaccagctgcccacccactagggggggcccattctctgctcaccccaacagaggcagctgtgctcctccaagacatcccttgtggtagcaggtgggagagagaacttgaagtccatctgggaacacatcaaagccatatctttgaaacaggtttaacggtaagtcataaagctaatgttttaatctccactggttaaatttactggtaccctagatacaaccttctatttataagactgacaatatctcaagaacaaatcactcttcttaaccacacaagccacctacgcatgctctgtatcaaagcttgttttatttaaccatgacattttgccaatgttacttcctcaacaaccaaaatggttcacagtcatcccatgaactatttgctaagtgccttctatgggccaggcactgttctggcaataggcctctgtcctaatgccaacgaaaggagcttatctgcgggggaggctgactgataatcaataagtaaaaaataaattcaagaacagaaacgttcagagatgaagctaaaatagaaaaatgtgatggaggctgggggaagcagggagacctgctttggtttaagtgatgagggaacagctatttaagatgacattagagcagaggcctttctgaacacaaagagaacactgagcacaacgagttggagagaagaatgagctttgtcaagcagagagagtaagaaaggcagtgggaaattggtgggaaaaggcaatgtggccagagtaggcgagacctgacacacttggtatcagtttcctggtgctgctggacaaataactacaagcttaaagggattacctgacaattctaggtcagaagtctaaaatgggttggcaaggctgcattccttctggaggcactagggaagatgagctcccttgcctttcccagcttctaggggctgtccacattccttggctcatggccccttccttgcttctctccaacttctgcttcctgttgtcatttctcctgctcagagtcctcctgcctccctcttgtatgaacccttgtctttacattgggcccagtggatacatcaggaaaatctccccatcgtaagatcttcaccttcctcacatctgcgaagttcctgtttccatgtaaggttccagcattaggacgtggacaactttgggggtcatttctgcctcccacacactttatttctgaacagtgtctgaaatagcagagtgatgtgatccattaacttttttaagatcacttgggctgctgtgtggggaaagggcaagagtggaagcagattagtcagcaggttattactaatatatatttcctattccttaaaatctctacagatcctaaaatattatacaggtaggctttttaaaaaatggaattagagtcagaaatgaattagcaacaaccaatcaatcattacttacacagaaagggcacgagtactctgagtcatttttaacggcatctctgacgtgctcaaatgaaaacattaaaatttaagtgcagctgacctttgaacaacatcaggtctatttgtacacagattttcttccacctctgccacccctttgagacagcaagacaacccctcctctttctccttaacctactcaacatgaagatgacaaggataacctgtgtgatgacccacttccacttgatagtaaatgtattttctcttccttatggttttcttagtaacattttcttttctttagcttactttactgtaagaataaagcatataatacatataacatacaaaatgtttgttactcaaccctttatgttaccagtgaggcctccagtcaacagtagactattagtagttcagtttttgagaagtcaagttataggaggattttcaactgtgaggggtgggggcaggggtgcaggtggaggtgtcatctctcctaacctctcatgttgctcaagggtcaactataagaaaagaagggcctcaaatcagttatctaaacttccaccttaggaagctagaaataagagtaaattaaacccgaggcaaacagagagaagaaaataatgaagaaatcaatgaatagaaagaaaagcaaaataaaggaaaccaaaagccacttatttgaaaagataaacaaaagtgactaatgttttgctagtatttaagaaaaaagacacaatgtatcaatatcaaaaataaataatcagacatcggccaggcacagtggctcacacctataatcccaacactttgggaggctgaggcaggcggccttgaggccaggagtccgagaccagcctggccaacatggtgaaaccccatctctactaaaaatacaaaaattagccaggtgtggtggtgcatgcctgtaatcccagctactcgggaggcggaggttgcagtgagctgagattacactgctgcactccagcctgggtgacagagcaagaccctgtctcaaaataaataaataaataatcaatcagatatcattatagattcaatgtagtaaaaggataaggaataatatgaacaattttatggcaattaacttgaaaacttagataaaacacaaattaccaaaactcactcaacttaaaagacacaaattaccaaaactcactcaaaaagaaatgtaaaccaaaaataaaattctgagttcgccaactgactgatggaccctcccctccaccaagggcaatccaaagctaacctgagaaactagttcaggccatgatggaaagtgggagtgggagtaggacattcttcattatactctcctcccgttggaattcaggcacagatgaccagcattaacatcaacacaggacctgaagactgacagaacaggccctttaagtctgacaagaaacatttacaatctattttctctgaagcttcccacctgaaggcttcatttgcataataagaaccttggtctccacaactaagacactgcctttcactgattccaggtctttagataaattctttcaaccaattgccaatcagaacatcactgaatctacctataacctggaaggccccctatccctcactgcttccagttgtcccacctgtccagactgaaccaacgtacatcttacatgtattgattgatgtcttatgtctccctaaaatgtataaaaccaagctgtagactgaacaccttgggcacacattctcatgatctcctggggctggtcactcatatttggctcagaataaatctcttcgaatatgttacagaatttgacttttcaaacagaagaaactcaagtagccctgtatttattaaagatatcaaattcatagttacaaatcttcccacaaagaaacttcctagaccaaatgacttcgttggtgaattttaccaaacaattaagtaagaaataataacaactatgcaaacttgttcagggaaatagaaggaaggaacatttcccaattcattttatgagaccagcactatcctgataccagaactacagaccttacaataaaagaaggcaaaccaatttcccttatgaaaagttataaaatcctaaaaaacttaagcaaatcaaatccagcagtatataaaaaggattaatgatcgagaggtctgttccaggaatacacaattgttaataattgataatcaatcaatcattcaccatattgacaggctgaaaaataatatgagaatcttaatagatgccaaaaagagatttgacaaaattcaatacatgttcatgaaaaaaaaaaaatgcctcagcaaactacaaataaaaagaaacttttcaccctgatgaactgcatctgtgaaaaaactacagctaacatcatacttagtagtaaaagactggatgccttccccataagattgagaaaagacaaagacgaacactcacactgcttttagtcaactctataatgaaaatgtaatggatatataaaaaaaaataaaaggtgaacagataggaaaggaagaagtaaaactatctttattcacaaatgacttgactacctttgtagaaaaccccagagtatctacaaaaaagagtcctagaagtaaaaagtgcatttaacaaggttgcaggatacaaagacaatatacaaaaatcaatatactagcaatatactagtaataaaaaattgggagtaaaattaagaagaaatgccacttacagtaacatcaaaatatatgaaaaacttagaaataaatttaaccaaacatgtctaagacctgaacatggtaacagacagtgcggtattggcattaaaaatacccagagaaggccaggcgtggtggctcacgcctgtaatcccagcactttgggaggccgaggcaggtggatcacgagatcaggagatcgagaccatcctggctaatacggtgaaaccccgtctctactaaaaatacaaaaaattagccgggcgtggtggcgagcccctgtagtcccagctactcgggaggctgaggcaggagaatggtgtgaacccaagaggtggagcttgcagtgagccaagatcacgccactgcactccagcctgggtgacagagtgagactccatcgcaaaaaaaaaaaaaaaaaagtacccagagaaccctgacataactcacacatatactgtcaactgatattttagacaggtcccaaaataatgtaatgggggaaaagttggtctgacaaatggtgctgggagaattgaaaatgcaacaaaacaaaaaccccaaaaaaagccacctgtgtataaaaaaaatacttcgtcgtttttattccaggttcctggcccaaagctcctaaaaccctcagaatttcctgagtgacagagtgtcttttgttattcctaacatgcccttctcaaccaaacctgagtttatgctaatgaactgactcttagagggcccctagatagctccaggacaggcgctggtcaccagaaatatcaagccatgatcagagggttagaactttcagtgccctacccacaccttcagggagtgagaggagctggagattgagctcagtcgccaatggctaatgatgtaatcaatcattatgtaaagaggcctccataaaaaatccctgaaacagggcttagggagctcccaggttagtgaacacatggatgtgctgggtaagtggcacacctggagagggtatggaagctctgcaaccctccaccctaactttgctctaagtacctcctccacttgactgttcctcagttttctcttttataataaactggtaatagtaaataaagcactttcctgagtttcgtgagatgctctagcaaatcccattcctgagaccaattatgacgtctttttttctaacaccacttctgacaccaaatgtctgagggtttccacaccaattcttcaacatcaagcgggtatccaacaattcagttaaattctgccaccatccaaaattagtgggatcccacaagttaaggggtcccacaaggctgccctcacttcagatgcaactcacaagtcccaggggcaacccatatgtctgaaacaaccagctatagatttggggattcccctaaactcctcaggttacttaattcactagaatgactcagaatttaaaaaaaaaaaaaaaacactttatttactatatgcaactcaggaacagaccaatggaacagatgcatagggcaaggtatgggaagagggagtacagagcttccatgccctctttaggagtgccaacctcctagaaaatcaatgtgttcaccaacctagaagctccctgagccccattttttgttttgtttttttgagacagggtctcactttgtcacccacgctggagcacagtggcacaatcacagctcactgcagcctcaatatctcaggctcaagcaatccttgcacctcagccccctcaagtagctgggattacaggaatgtgccaccacacccagttaagagggttttttgtttgtttgtttgtttgtttgtttgttttggtagagatggggttttgccatgttacccaggctggtctcaaactcaagccatccacctgcctcagcctcccaaagtggcagaattacaggcatgagccaccgtgcctggctctgaaccccgctgtttaagggtctttatggaggtttcattacctccatagggagacatgaatgactaaatcactggccactggtaactgagctgaatctctggcccctttcccctctggggggagagggtgctaaaagttctaatcctctaacccatggctgctttttctgacaagctgcccccccatcctgaagctatctagggtcatctcattacacaacaaaaagcacttggaccattcaggaaactcccagggttttaagagctctgtaccaagaacaagggcaaagaccaaatatattttttattctctttcacaacatatataaaaattaactcagaatacttcagagtcctaaatataagatataaaaactacaaaagtattagaaaacaggagaaaatctttctgactgtggggtaaaacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagtaattctacttctgactatttacctgagagaaataaaattatgcattgccaaaaaggtgtgtgtgaatggtcacagaagtgatgcataaaagccaaacgatggaaaaacccaaatgaccatcacctaatgaataaacaaaccgtgaaacagtcatacaataaatactattctcagcaataaaataaaatacatgccaataaaatgaaactagtgaaacatgaatatggatgaagctcaaaccattatgttaaatgaaagaggtcagacacaaaagactacccatagtatgagtcaatttattttaaaattacagaagatgctaaactaggagcagcaaggagattagtactttcagagatcagggcaagggaaggggcttgactgcaaatggacacaagaaaactttttaagtaacgaatatgttctgtatcatgattctgatcatggtttaaatacctgtcaaaattcatcaattatacattttaaattggtaaactttattccaagtaattcatacctaaataaaacattttttattccaacaaacaatatatgacaacaacaaaaaaacaaaaccctatatagctaaactaatacaaacttgttaaactactacaaatttgtggtatctatcccttcacgttacttatcaaactctctgaaggactaacagttaaatacataaatatgacaatctaagattctgaaacaacaacggccaggttacttcatagtccaacgtgcccacacatctatccagatcatgacatttttatccatatgaacagcacacaacattcaataatgcatgttgacaattttagtgacaagtcactctttagtcataacataatttactagaattcaaaagcagaagcaaaactacctttacttttttataaaacccacactggtgtaattcagtgaaacaatttagggttctacatatagcaatcaattaccaagaattgtttatcatatatcttaggaaatttcaaaagaaaaaatcctcattctcagtaatttctcacaaaatttcatttcaaaaatgttctggtaaaaacaatgcatgtgcactttgttactttgaattagaaaagtaaaagaacaaaaataaacagatgacggtgatttcacatttacatccaacgcagcagcccaatcagacttctttagaattttgtgattggcaaatattaaaattttaactacataaacattttgaaatagcagaattgttttgacttgtgtgtgtgtgtatgtgtgtgtgggtgtgtgtatgtaaggcagagagacagacacacacacacacacacacacacagagagaagagagagggagagggagagagagagaaggtaaactaaaagtgattaaacagtttttagaatatgtaaggaggcagcacacattcagtccaatctcacataatccatgtagccaatgcttcacaagaagctttgactaacaaaattatttttcttagtattctaagagaagtacaggcaagccatgaacccagaagtggtgttctaatctacaagaaagaatacacaacagtgattcccaacctgaagggtatgactgtgatcacacatttacatccaatgtagccggccaaccagaaagacttttccagaatgtcacgatcaacaatatattaaaatttggggtatagcacaccatgtgaaaacacattatgtatgggaaacactgtctgtatctgtgacaactatgacatatttttatctgtatttacatattactgtggttaatagaaacatccattttaatacattactgtaacaatgacattttgacattacacaccttctcaatgtagggccactaaaatgtctaagtgtataaaattttaagaactttaaagagacacctcatattccttctaggttctagattagaaaccacagtctaagagaaaactctgtcctaactgtcaagagaagtagtttcagctaagccaccacctttaaccaggtctttcacttcacagggattctataaaattaaagggtctgaattattctataggaactcttttagtctaaaatttatcttctcaaatgttgtaatgggtcgggcacagtggctcgcgcctgtaatcccagcactttgggaggccgaggcaggtggatcacttgaggtcaggagttcaaaaccagcctggccaacatggtgaaaccccgtctctactcaaaatacaaaaattagctgggcattgcagcaggtgcctgtaatcccagctactcgggaggctgaggcaggagaatcacctgaacctgaaagtcagaggttgcagtaagcagagatcataccactgcactccaacctgggtgacagaacatgatttcatctcaaaaaaaaaaaacaaaaagaaagttgtaacaacaatttaggaactcagttaatatcccaattttagtttccaaaaaaagaaaaatacactaatatactttgtatttttcaaaattatttactttgcatatatttgcttaatataatttgttaatataacgaagttatttcagaaagtttgaagacagaaaaaatatcacctttaatccatgatcttttttttttcattttttcaaacagggtctcgctctgtcacccaggctgaaatgcagtggcacaatcacggctcgcagctttgatcttccaagctcatgcgactctcccacctaagcctcctgagtagctaggactacaggcacgcaccaccatgcctggctaattttagtatatttttggagagacagggttttgccatgttgcccaggctggtcttgaactcctaggctcaagccaactgcctacctcggcctcccaaagtgctgggactacaggtgtgagccacctggcccatgaacttattggcacagacatagtttacacagctacagtaataatggccataacattttatatacaactctctctatgcttgtaacaggttattttccacactccatgtatatcactttataagtatcgtatttatatgtctttatatgtatgactttaaatatctacttaacattctaatgagcgcatcggtatataataagtcacttaaagagaacatcctggtagagtccttagaaaatttcatccttgtataaacatcattgagtatatatacacaaacctagatggtataggccaggggtccccaacccgagttgatgaatggtactggtctgtggcctgttaggaaccggtgacacagcaggaggtgagcacaggcaagggagcattactgcttgagctctgcctcctgtcagatcagcagccgcattagattctcataggagcacaaaccctaccgtgaactacgcatgcgagggatctaggttgcacgctccttatgagaatcaggccaaggtggcctgatgatctgagatggaacagtttcaccctgaaaccatcccctacataaataggatatatggtataacatatttctcttaggctacaaacctgtacagtgactgtattgaatgctgtaggtaactgtaacacaatgctaagtatttatatgtacctaaacagaaaacgtacagtaaaaatacagtattataatcttatgaggctgggcacagtggctcacccatgtaatctcagcactttgggaggcctaggcaggtggatcacctgaggtcaggagttcaagaccagcctgggcaacatggtaaaaaccccatctctactaaaattacaaaatttagctgggcatggtggcacacacctgtatcccagctactcaggagactgaggcacgagaatcgcttgaacactggaggcggaagttgcagtgagacaagatcacaccattgcactcctgcatgggtgacagggagaccccgtctcaaaaaaataaaaacaaataatcttatgggaccagcattgtataatgcaggctactgttaaccaaaatgttgttatggagcacatgactgtatttgtgtatatatatacatatatataaaataaagtaaaatactaggacaaaaataataattatttatattaggggatgaataaagtagaggaagtagggttagagagagttctctctgtatacattttcatacattttgacctaccatgctacttttttaaactaaaaattgattaaaaaacttaaaatgtaagtgaagtacttaataatgctaaataatagatttctgagaagtcagaaatcacttggcccaacctccaatgcaatgtaggaatctctttaatgtttatctgttttcctagcattttagaaaaaagatgtagccaaatttactatcagtaaataggagagtggtatgagacaattcagagaagctgcttattatatcccaaccattcctgaaaaaaatcagtgaattaaagcacagtttaaaggctgattaattccagcaaataaatgctgagtccctgttgtttgctgtgttctgagaatgtaaaagatgattctcaaagaataagaggagttcctatgctcaagaaatttgaggcaagaccatttgctaagctttaaatatttagaaatgagcaaggtatcactggaatacagtattaatatatacagagaaacctttgtgggagaagaaaaagaagagggaaaatgatgactttcaagggatggagaagaggctaaaaggataatcaataaacggtacactgtgtttttgaggtttcttttttttttgagccggagtctcacactgtcacccgggctggaatgaggtggcgtcatctcggctcactgcaacctctgcctcccaggttcaagcaattatcctgcctcggcctcctgagtagctgggattacaggcacctactaccacgcccagaaaattttttgtatttttagtagagacagggtttcactatgttggccaggctggtctcgaattcttgaccttgtgatccacccacctcgacttccaaagtgctggaattacaggcatgagccaccgcgcccagcagaggtttcttttaatattactactttggagtacaaattaaagctttaattatgtgaaagaccacattcctcaacaataactgataaatgtggcctgattaagatgtttatactaatataggctgtaagtttaaatattctttaaataatgtaaagagattttatttacctataattttatttcatatgtacatgttaaaagacagacctctttgggaggccgaggtgagcggatcacgaggtcaggagatcgagaccatcctggctaatacagtgaaaccctgtctctactaaaaatataaaaattagccgggcttggtggcgggcgcctgtagttccagctactcgggaggctgaggcaggagaatggggtgaacccaggagccgagatcgtgccactgcactccagcctgggtgacagagcaagactccgtctcaaaaaaaaaaaaaaaaaaaaaaaaaagacagacctactggtcagcttataaatgtaaatacatgtaaaaaagaggccatgtgtggcctgtaattccagccctttgggatgccgaggcaggtggatcacctgaggtcaggaattcaagaccagcctggccaacatgttgaaaccccgtctctagcaaaaatacaaaaatttagccaggcgtggtggcgggcatctgtaatcccagctacacgggagggtgaggcaggagaatcacttgaacccaggaggcagaggctgcagtgagccaagatcgtggcactgcactccagcctgggcaacaagcgtgaaagtccgtctcaaaaaaaaaaacaagaaaggaaaacctttcggagaaatctgaaagaacagttccatcatatacactgaattactaaaagagaatgatatgccccaatttttctataattaagacactgacttttgttgacaaaatacagtcacaaatcttgagttaaaagattatcctgattgtacgaaagtttaaaagcacataaagcaaagtaaatagattaaattaacttgttaaaaagtactcaaggctaacatgttattctaataaacagcatgtggtatattatttgaggacattttgcatgtcctcaaaaaggcaatctgtaacagacatccacaaactgtgctaaagcattaaagcttttttcaaagtatattcctaatgcagaaatctagaacaaatgggctgcaaaagaatatgtaaaataaaaagaattccaccagtaactatagtgcaataattataaaacctactgccaacagaaaaacaatgccgggatgaccactaacacttatttttaaaatgttaatctgtcttcacaacattgatatcactcctcaaaaattcatataattgggccttctttaaaaaccctaaagctactctgtatcttcccaataagccatccaatgacctttagagaacctctcaaccatcagtcatgtgttatactcctttacctcaagatcatattcacctggtgaatatgatctagacataagaatcctaattctcttgatataagtctttcacattgtttaaaaaaacaaagaactcaaaatatacataaaacccttataagcactcctactaagcagacagtattactcacatttgacaaatgtgaaaacagaaatctgtactgcataacaccataaccctagcagctgggagtaataaacctacactctttggttactcaactggaattaaaactaattcttttcggtatcctacattttaagaaatgtattaaggaggcaataaaaccttatcaaaagccaaaatacactgcatatttctaaatatcacactattctgcaatattttaaggcagaagccacagagattgaagctttaaaaaattgagaatccttaagaatgaaactaggggccaggcacagtggctcacccctgtaatcccagcactttggaaggccaaagatggtgggtcacttgaggtcagcagttcgagaccagcctggccaacatggtgaaatcctgtctctactcaaaatacaaaaattagctaggcgaggtggcaggcgcctgtaatcccagctactcggggggctgaggcgggagaatcacttgaactggggagacgagggttgcagtaagcgaagatcacgccactgcagcctgggtgacagagcaagactctatctcaaaaaaaaaaaaagaatgaaactaaagaatattggccacaattaagacacaacaaacaacattgtactacatgtactacaggtactacaaacaagtattttaatggctcaaagattttttttcaacttccaaaacaatctaaatgttgcaaaagcttctttctaatgctgacagactaagcatgtttttttcttgtgaatcagtaaaacacagacaaagaggagttgttggtaatggggttcaaaccaaagaacattctaatggaaaacagattactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgccataagctctgtttattccaagcaccacaattcctagttaaaggggaaaaaaagtacaagcacttgagtgagcaaggcattcagagaacagactctacatcacacatctagctagcttcgaacttaacaaatcaaagaaattcatgacatcacgttcccttcaatcgatctcttcttaagcaccaagataatttgcaacattttggtaaattttacatcactaactcaaactagagggaagactagacttattagtgaaaattttaagttaaaggatactatttaaaatgtggtttcatcatcttcaagtagataccaaagtaaccgctaataaaccttgtcacatgcaggtattatagcatctgctttttctaggaccagttgttaatatctccatttttttgttgttcatactacacagttttcagtaattctatcccaagcttctctcctgatttctgtctgatatacttaacctgagggcacttccatttagatgtccaagaagtacttccaactcaacctatacaaaacaaagttcattatctctcccacaaacccagctgtcactcctaactgccccactttttaatcaaagaccatcacctaaacccagcctcccattccttccagttaccaattttctaaaaacagtactatgcatagaatgcatcccctacttaaaatcctttcattatttatttcaaaatatccaacttcaaagatcctaatttgatattcaaagttctacacaacctctactaaccttcttgttcttggagtagacaaattttcacagtgtatcagaaataccttccactgagtcagggtgggtatgtttcttatttgcaactgagctaaactgaagacaacaaaatgtacacatgccttcgctgtgcaagaaactgtgcagacccattctttaaagtataaagatgaacttctgctcacaagagtaaatttgcaagaattccaaatgctctcagtacagagaaaagcataaaggactgctatctgacaggatctgtattaaacagctgaatgactttgggtaggtcccaatactactgacaacagctaccaccagtaggcctcaggcactgctccaggtgctttaagcgaattaactcatgtaatccccaccacaacccaagaggtgggcactacttttatcaatagttaacggataaagaaatggagacttggagaggtgaagtaacttccttcagctattaagtggtaatctaactctatacttgaataaaactgtgttacactgttcaagcttcagtttcctcaggaagaaaatcaagcagctaagactagatgtgtccattcattcaaacatactgagtacgtactatagtgatcagcagccatggaactagagtctaggagggaaatacaaacattaataatcatagaaatcattaataatcataaatatcattaataatccattcaaactgctttacaagctgtaagtggtgctacagtaacttgtaaccagaattgataatggtctggggcaaaaggagatggttagggaaagcttaccccagacagtgaaggttagaaggataagtaggagtcaaggtgagagtgaaggagaggggctgactgccaggcagaggaaacaggaaaagcataaactagtcatggtcccactgaatgtcctgtaacctacgagggggagaagagagtgaccaatgaaagtaaagaggtcagcacaagccagaaatatccttacagaccttctaaaaagtctggtcttcatcctaataaccattgaaggagtttacgtaggtataaacatatacacatgcacatataaaactggcgggggaatagtttctatacttggagatcataccagaagtagacaggggtgggagcttcaagacacaattcgagtccaatcaacagataacaggtttggctgagattggtggtggtaaaaataaaggaaagtgaaaggattcaagaactattcaaaaattttaaatgagttaatgatgcctagactgaggactgatttaactggaagaaagtgttaaggagtatttaccaggtttctggcttcaccaattggatgaaagatgacatttaatgagacaaaatcataaaactaccaaggtgagggtggaggggagtaaagctcatgagtttctgtttttaattaaagtgaatctgaagtgcctttcagacatccaagttgatacaacgtccaagggctaagaatgcaggctctaaggtgtgattgctggggatgaaatcccagtctgccgcttactagctattcggcaagttacttaacctctgtgatcctcagtttcttactctattaagaattcggcaagttacttaacctctctgatcctcagtttcttactctattaagatactaacagttccacactccatgggactgtattagaatcgaatgatatgatacatgtaaaatttacaacatgaggacccaattaacctcccttctagcatgaacacctctcatgcagtaagtattaaaagtttcaccataatttctgctagatatgataatgctgacattattactgaagggtaaagtgccatcaaaatgtttctaacacagttaattccagcaattttggtcccatatctgagacttgatgttttgagtacttccacttcaaaaagctagaaattagctctgcaatctgaaatgaattatctaatatgtaacaactgtaccatcaaatgtatctgtaggcttttggtattctaaaatggaataaaaccttagctttattcagcaaagtctaaaagtttttttttataactgtctcactttaattcacaattcaatcacttctcaagaactcaattatcatgcatcctcctcacataacctagaaagtttaccaaactcagaaaagcttaggcgttcacatgccaaccttaattttcctgacttttcacaaaacatacaaaaatcttcagtgaatctgtaacaaggtcacatcacagcatgaatcctgctctataaagctcacacaactgaaagatgaatgtaacaactttgctgagactttaaaaacaaaacaaaatacgttctgcttatacaaaatgaaaaaatacactcaaagtgaaagtcctccttccctagaaccagctcattcccttccccagaagaagccacagttatcacagttacatgtaatgtaaccttccagaaaatgttcaacgtatctacatacagaaatagagttgtatattaccatttggcttgttgttgctattttacataaatggatcatatgttctgttggagctattctacataaataggttcatacattttttctttttttttaagagacaaggtcttgttgtgtcacccagactggagtgcagtggctccatcatagctcactgcagcctcaaagtcctgggcagtctccatctcaaaagaaaaaaaaagaaaagaaaaggaaatttggttatagagctatgcctcctacaacaaattacaaatatggagcccagataacagatgagacctggtgtattctgcactacttacccccacccacctaaagtgctgcatgctgtttgaggctcctgtgactaggagagttatcctattccttagaggctgctgagagcaccaaattttggacccacctctaagagaaataaaggcacccaggaaactccttcacctgtagtacccttgacctcatgtttttctttgcactgcttattgctggttcaacagtaaagcaaagcaaagcctaggtaatgttagccaagcctgagtcgtcattcttgccaattctcaaaggaggcggggtcaactttaagaaaccatgatgtatgtcctatctcatcaggaaatcaaggctaaagaaaaaaaaaaaaagaaaccatgatacccaaaaaaattttcgtttattatcttttattatctgatattctctcttctgtccattcagatcctaacttaaagtctgtccagacattctgcacaaatattcctttaattgcattcaagtcataacgaccaaaaaaatagaatatggtgcatattagtagctgtacttgcaatccctttatatctaacatattgttggtacacttaacggaagtgaagtcccggcatgactaagcttacccaaaagatgatggcattcaggctctaatcactccagtgctagtctatgcttccagctgaatttcttactattctgcttatgccacacttgccttatgttacgtcccaaatacaccacacatgttcacatctccatgcctttgaccatgttcttgtctctgtctggaataataagtaaggaataaagtcattcatcacactcctgaagcactgctacgtgctagtggcaatttacattaacaatctcatctcatcttcataacaaacctataaagttggtattgtttttcctgttttacacgtgagataagtctgcccaagaaccctcacaaatggcaaaatccactgcctattaaagaatgccttggaacccctttcaaatggcgaaaccctgcaggtattacagccctttcctcttaccatgccttgaaagttcacacagcctactaataaccaggatctgcttcactacactaaaaccaatcacgacttacacgcttttcacttctgcttaacagattataggtgctcaacaaatgcatgtcaaaattaaaacactggtcctctggcttaacccggaggttaagggtggaaactgctattccacccttcacgacccttttagcttttccctgcactgccagtgaaaggaactgagctgtaacagtattccctaggattgtcagcctccttcaaagccttcaaagctctgtattgtattgctaatgatgtctcctcccgtagaaggtagctcaagggcaagatccataccatccacattcttatcgccagagctgaggaaaataaaaagtgctcaaaattgtttaaatgaagtggaacagtccctcaagactaactttctaagagaaaatgaacaagaggaaaaattgttccagctgagcagcttcaaatttaagattctccgtaataataaaaggcagtttcaccgcagcttttacaactccaccactaatagctgagtttacagaaagccattacacagcaacaataaagcctggtagcaaggattaaatccccagggtatatattgaccttggcttgtctggagcggagggcgtaagctgcacttctgtttgccgcgctgaatgcggtcactttacaggtaagctgctcgggggtacacgtttaggttattaaaagcaagaaataggtgcacaaggaagcggccacgctgggtgagtagggaggtgagaaaggggagggacccaggttcggtgcgcctgcctgacctcgaccccgcgtcctgccggcggacgctgcaccttatgcccgtcctgagagcgagcggccgcccgctgccccgcgcctgcccagcgttcgcacctcacctcggttctcctcctccaggtgccgcacccgcagctcgtcctccgtcttcatctcagagctgtagccccttttcggggcgggacccccggccgcaggtacccagccctgggcccagatcgccgggcccgctcgccggcctgccaacgagccgggcagcctcaaccccgggcagagccacgcactgcaagcggccaccaggcgggcgccgccagcatgcagggatcccaaggccccaggtgccgccgccaccgcggccgccatgttgtctgtttacggcgtggacctgcgacggccgc

SEQ ID NO: 263 - DNA, 218 bp, Homo sapiens
  source 1..218: mol_type = genomic DNA
ttccttcacctataaaatgagaataattatgcccatttattgggttgataagtatgtaaaacacttggcaccaagaaagaaatagagcagcgtggaaatattagctaccatttaccaacttccttcttagtctatttaagaaggcatttcgctgtcttatttaatgttcaggaaactttcaagttggtattactacccccatttttatagatgaggaa

SEQ ID NO: 264 - DNA, 14818 bp, Homo sapiens
  source 1..14818: mol_type = genomic DNA
ttctgtgtttgtcaccaatcctttattgaaactggtaacttacacactttataatagaacaacaaaaataatgttcaatatatacagccttcgcatggactatctgactatacacaggcagagtgataacacaatctaatcttcatcataatctgtgcacaaaaagacaccaaacagacaacatgtgcacatcacagtgaaatgacatcacaggtccagtgaaaattcagcataatacaaaatggactgctctattgcaaatgacatctttctaaatgcccagctcttactcagtagtaatttacccagagtctgaagcagagattggttgtgtggctataagtctcttgagtgagacaacctctgcagataagtttgctatcccctgcttcaaatacaagttctctgggtcagaaactttgtagccactgtctttcatttcaacaactccagttttgaaactattctgagttttgccactcagttctttttgatgccagtgctccgatttgagagaccaatcttgaatgttagtcacttgcactgagaaaggagtaagagaagaatgtaccatacttggggcactatgcttttcgagttcgaaatgtcttttagatgtcatgtcaataggtgaggaaagtttttgcgtggcctcaaattcattatcaaaggcttctactttgatctgcatggctttggctttgatccggagcttgtgtggcaaggcagaggaattcacttctggaactttaaccacagttgcatgcacatgcttgagttcaactggagaatggatggggcccttggggacctgttgctcgtcttctccatcagatgactttcctaccacaccatcatcagtttccgacgttctcggggagttgctggaggatcggttgacttgcagtagtgggggagagtgtgagtacccagagaaagaattccccatatagttttgatagatggacgctgtgtaagagcctcggtcatctcttggctcccttgtgtagctctctaattccatcggctcttgcttgataatctggaacttgttttcaggacttctgcagcttccctgcacagagctctcctgcgtgtgttctactgaggacacttctgaaacatcggacagcgagctttgtggagagtgtttaatgacagaaatacaactacttgacaccatcgagggttcgtgctcgtccacaaatgaactcacattggatttggaagtctggtaatcttgaaagtacacagctgtagaattactgagtttctgaatctcttgagcatatgctgtggagctaattaaaccaaactttaattttagtgaaagcagctcagcttttaaagtggcgttttcttctcccagtgcaattagtttgttctctaaaaccaggtcattcagtcgacgcttctcacgagatcttttggcagcttcattatttttccgccttttttcccaatacatagcatctttcttttcatcaggaatgaattcccgtttcctccgacatgcagaagatttgttcttccccacacttccttcactgagaagcagctcctcacctgttgtggagtcttctgacacttccgttaaagcagaattaaggaccatcatcttgtccacattgctactggcatcaagagacgcctgctcctttttgacggtctgcatttttctcagctgcatcagaaacaaccttaccctatctatgtgtgtaggagaacaaattaatttccccgtattctcaagctctttaaaaactctggtttaaaatccatcaatattcttccttttgttctaccgtctgggataaatccgtcaggctccttattgaatgaagttgggcctccttcgttatctgcaatacatgaataaaaaaaaaaccagttattcactggataaatgtttattacaaattatgtacaaggaaatatgctaagcatttagggcatacaagcacagatgaggcatggccacagttctttctttcaacaagttagcattttcaaaaaggaaataagttcccaaatacctaaactataaagctgtaaaggacaaatccctaatgaggcctatcagtaagagaatatgtgatccaggaaagtgagggaaaaataaaataacctctgcccagagagaagtagaggaaggctgtatttaatgaggcgaaatggagaaatagttgggtgtgggcaattacaggaaggaaatgacagatagcctctggttggtaagtttctaaacagtacatgcataccgtggtgcttctaaataatgttacctaatatttacatcactgccaagcagatatgctcacctcttaaaagggactttaccaagtaaactttaacgtgagtaaaaaaaaagttctgcactcctatatggaataaaatacaaatggagacaaacttcttctacaaaaactaaagtaaaagccacattaacaacggagctgttggttttaatctacaccttaacgtggacataaacctgcccatcacatccttgactgcctggtaggcttatatcccagcaaattccaccaggtgactcactgcaactaaatgaaaaggattcttctccatcaagccatctctttacaagcatctgagtttaagagattagaatttttttttctgattcctttgaatttgttctatcaaacattcaagattgaagtatccaaaatgctttttgtgatcttgaaaattctgtcaaaatagatttcaggtttcagttacatagtagctttgaactaaaaaacagttactaggcggggcacggtggctcacacttgtaatcccagcactttggtaggccgaagcgggcagatcacaaggtcaggagatcgagaccatcctggccaacatggtgaaaccccatctctactaaaaaatacaaaaattagctgggtgtggtggtgtgtgcctgtaatcccagctactcgggaggctgaggcaggagaattgcttgaacctgggaggcagagattgcagtgagctgagatcacgccactgcactccagcctggtgacagagcaagactctgtcaaaaaaaaaaaaaaaaaaaaaaaaaccccacacaaaacaaaaaaacacttactattcaaagggggtttttaaaagtatagtgcattcttgaaatgaaattcttttaaaccaagagaatatagttacagaaaaaaatttctttcatttatatgaattagtttcaagtaaaatataacaactcaaaaatagaatcattcattagtttcctcttccattgatgaaatacttacactacaaatttggcctgacagttgccttagctcgagataataaaatccatgttatgttccagtagcaatcattgcatgggggcttttgaatttaactgtgtttctagacactgattctctgcctaatgttccagtcagtaatatttttcgttaaatagacatggtacaacagttccatcagcacgatctgcacacagtggcactttattctaccctactaaaaagatgtaatgagccaggtgtggtggctcatgcctgtaatcccagcactttgggaggccgaggtgggcggatcacctgaggtcaggagttcgagaccagcctggctaacatggtgaaaccccgtctctactaaaaatacaaaaattagtcgggtgtggtgacaggcgcctgtaatcccagctactcgggaggctgaggcaggagaatcgcttgaacccaggaacccaggaggcggaggttgcagtgagccaagatcgcgccattgcactccagcctgggggacaagagcgagacttcgtctcaaaaaaaaaaaaaaaaaaagatgtaatgttcttacatgatgccactatctccttcttacgcctagtttcataatgactaataaaatgaagtttacttttatcaattggaaaagcctgccagcttcttttgtcttttccagggaatgaaaggaattatgtaataatttcaggatcataaagaataatgtttcatgccaggtttttgcccattaaactgagccaacatagttaagggaacagctagtcgtaactcagagaaatttgtgattattaatatcaagtttctgtttgttttttggtaatgaaactttaataggaaatgaaggcaaggagtgtgtcacagtcagcagtgatgttgcagagaaggaatcttcctatttatcatttaaacaatattatttccttttttttttttgataagagtctcgctctgctgcccaggctagagtgcagtggtgcaatcttggtgcactgcagcctctgcttcccaggctcaagcgactctcctgcctcagcctcctgagtagctggggttacagttacgcgccaccacgcccagctaatttttttgtatttttagtagagacgggattttaccatgttggtcaggctggtcttgaactcctgatctcaggtgatttgcctgcctcggactcccaaagtgctgggattacaggcatgagccaccacgcccggccaacaatactatttcctctaatttgcatttaggttttgtcctctaatatgaaaacccagtttcctttacatattgaatggattctttcctctgttgaagtctgcactctgccattcagcaaagtcctcctgctaaagtaaaatgagtggagaagtaaagaggaagatatcccagttaaagaagacaattgcactgacctttcccaaggcacctttcaaatctccactatactcttggccactacttttttccacttttagtttttaaacatcatatgatcccttgcagactattattctggttattttctccacctgagaatctttctcttccatgtgttatcttatttgttccttcttaaaaaaaaaaatcagattcctttattttgcctcacttactagatttacagtaatgcttttgaaatgccccgccattctgtctgccttagttactcttcctaaacttctaggaccttttcaaggttggggcccaattgggaaggagccttcacaataggtcctatttctatttaactgaaatagccccatttgtcttaaaatttccttaactcatgtcttctaggtgtctaagtactatatgactactttatcatctctacaactttgttggtacattaacctacagaaaacttcatttgcttttttgtttttgagacagagtttcactcttgttgcccaggctggagtgcaatggtacgatcttggctcaccgcaacctctgcctacagggtccaagcaattctcctgcctcagcctcccaagtagctgggattacaggcatgtgccactaagcccagctacttttgtatttttagtagagatggggtttctccatgttagtagagatggggtttagtagagatggggaaactccatggggtttctccatggggagttcaggctggtcttgaactcccgacctcaggtgatctgcctaccttggcctcccaaagtgctgggattacaggcgtgagccacctcgccaggccacctcatttgtttttaatcatcttcttcctatttgaatttcatggcatgtcactataaatctgtgattctgctctcatctgtatgtattacattcatggtctctacaactcaatggcaaatcaccacactatcttaggatattttctgtaatattatctatcaaataatcttgcagtgttgaaaagagtttatcagcattatgggatgatacggagacaggcacaatcatatacactgtgtgtgtttccacgtgtttgtcttttgtgcccaactacactgcgaattacttcagggcggaaattaaaatatacttgtcttctagcaaaaacctgaagatattaggtgctcaacatttcattgacagtcacccatataccttatataagagagttttgtaaacagaaaacttttttgatgctttctttttaatgttatgtgaattgtaaagaagatattttacttattaacagagagattctcttattcattaatttgtttattcaacacatatggagcacctactgtgtactgggcacaaggggagactaggggcacataaagagggagagaaaaaccaaactcccgagaccaggcgctcagtcgtgggtgggtgggagacaaacaggtgagcagaggggaaccaggtgtgagtgcagagttgcacaaacatgggcctggggtgcaggctttcttcttgtcatggagataataacaaaaacaatcataattggtgccatttattgaacacttaccacagaatgggcactgggagcctgacctgctttctttcattcacttttggtgacaattttcagataagaaaactaaggctcagagaagtcaagtgacttgcccagtgtcacatagctaaatggcagagcgtacattcaggcccagttcctttactctctcctacactttcacaggtggttctgcatctttgcaatgcagtctcatttacacacagttctcttttgtgtcactttcatttctgagtaatacatacccttttactaagttactttgggcgcagtaaggcactatgctaacttaactacttcttctttttttttttttttctttttgagaaggagttttgctcttgttgcccaggctggagtgcaatggcgcgatcttggctcaccacaacttccacctcctgggttcaagcgattctcctgcctcagcctcccaagtagctgggattacaggcatgcgccaccatgcccaactaattttgtatttttagtagagacggggtttctccatgttggtcaggctggtcttgaactcccgatctcaggtgatccgcctgccacagcctcccaaagtgctgggattacaggcgtgagccgtcacgcctggctccttaacttctcttagatgctgtcttaacttctttagccagcaaagatactatctagaacttttctccatcctccttagatgtttcagatctggcactatttatgaattgagaaaacattttattaattttcatatctttactaaaattttaacctcctggctattctaattatgttaaatagagaaaaagaaatatgatagctgtggacattgtcacctatgatcttcttcttttttttttttttttaacaaatccaagagtgtaatctgttttcaacatgaggcgggggacagtgtctctctgaccctctcattttgcagattaatcagctagaagacaggctgaccttcccaagaccacacagcagttgggcacagatgggctctgagctctccttatgcccctcaacaatgaacttaaagcaaatgcaaaagtagtttacgatgccttcaaaaagcctcaggatttatgctaacctaacaaatttatttcaagcctcaatattttcccttatgattaatttaacaattacttcatctatgcatcatcttttcaaatcaacatctaatgttgtggtatattagtcattgcttaagtttcttttttggtgaataattgacactacatgccaattctatgatgttagtgtattcagcacgattaacttcattacacacattagatgatatgactctccttgaaaacacaaataaaaaagagaaatttaagagcaggtattattacctaccagttgacatatttttccatacatactccgaaggtgccatcactaattaatgcttttgtatagtccatcacactacttctctaagcaagaattatatagcaagaattatatttcataagcccagatttttaaagtttaagtcagattaccctattgtttttaattaagtacaagatttgatttagaaaattctataaaagaatataacctcataacaataattctagaccaaatttatccttgaggagttatctcattagttatgtttatgatagacctttatcttccctggtctctcccagaactaatgtttaacaatccaagctccacaaaagaaaagaataaacatgctttgtttcaatcatctgaaatcttactaatagtctaaacattaaaatctactctgagaacattttgttattaattatctataaagggtaagttttattgcaaattgcaatatatattttgtttttaaaattctgtcaatagaagatgaaatactatttgatatgcccaatgatttggaaacattatagaattatcttattttccctctactctctgaatgtattgttttctccctgttatataatacagataacagtaaaggaaaaaaaaatgtcttcaaggtaaacctaagttatgttaaactgtaagccacctctccagtaagacagcagatgcttattttttagataaatgtcattttcatgaaaaaatcaaatcaattaatcaattcacatctctttatacttttaaagtatgaatactagcaatatgttaaccctacattttcttcctgtgggtaaaattcacagtatctgcgtcaatgaaatgctttacttcttttcatggatgagaaaacaatctagtatttaaaagcagagatgaaataagaaaagaattcactatacatgtacaacccagaggaaatggggagtgaaaaaactcagtcagaaaacaccgaagttgcaagagaattttctaatcccgttgaaaaagagaaggatttttaagctgagaaaactatgttaaacctctctaagggccattctgtccccaagaagcagcttaccccaaagttagagagaaatgtgcacttgatcaagacaggcaagacgcacacacacacatacacacacactctcgcacactgccagaatctattctatcatagcaacaaattgacctactttttctatttgggtgcctctgtaaataaatgtgtcaaagcctgatccagtttatgataaatgaaaatatttcaagttcgacaaaggactagctgaaaattaaatttaaatttaataaatacgatgacaacattgcattttattacatcactgatgtaatttaagtaattgaaatatgaaatagtataacttaacattcttctttaagaggtcgtcagtgtttgaaacttaatacacaattaaattattctgaagcctgcacagagtaagcacatacacgctagcacgaccaattaactgcacagcttgagaaataagaacagctctcactaaagatgggtagtaacatgggggaaaaacagaacagtaataattttttaaaaatctatagaaacttaaatgtggggactattaatatcttgaaacttctgaaaagataactgatcagtgtagcaactaatctgaaatcttaaaaggacaccaacaatcacaaagtaacccagttgtagaaaattccccaatgaataagtaatacatgcaacatggtgtaatgatggcaaaaatggtgggctaaggggacagtcaggctgagaaaattcttgaaagtttctaatgataatgtagaatcatcccaacttgcttcacttggctttttaatttctttttccacttttccagtcagtggatgattataaatgtcattttctaccttatgaatagagtggattttcaaatgcttatttgtagtgtttatttgaaggccagttaattacagtttaagacccctaaaaagctaattaataaaagacatcatgttctgataactaaaaggcttataaacatcattctgagtcctatgaaactgagtcctcaaagcacagattaataacaaatggcatctagcaaatctctagtaaactttcttatcataaaaacaagtttatgctctattattaaagccatatgagaaacagttttgggtgttttttttttttttaactacagtaaagttacttacaaagaaatgtgaaagataactggggtagtagtaataaaaattcattttgaaactgaaaaattcatattgtaatgtctgtgatcaaaggtcaacgtctttcaacattctcatacaagtccaacctggatagaaatcaactcaaatataatttagaaaaataacaggatatcaaacaatgtattaaaccccgtgaaatacaggcataccttacaaaaacaagaaatgaatattaaaggcaatttcaattacattgtttctgttatattttgaattgaatcccaagtgtgctctcattcctcaatacaaattaaaaataaacaactttaacagcatcaatggcatctggattacaatggaaatcatgaagtatatgagtttaacctgggtaaaaataaagcccaggcaatatgactgcaccttttccattccatgctgcaatcgcatttacatctcgaaattgactctaatgaccaaggcaaggtcaactagaaaaatccactcagctggtgagtcaggcacattgctcaacgtccgaaaggcctctcacaaagggttttaattttcaggctgttgcatcacagtgatgttataactgcactgcacaaaaataagtctttaacccagaaaaggaaattgtttcaaaaactacagtgagtgtgagaatacactttgttgaggtgcaaatttccccatctggttttcaggctctgcgacctgggctgcaaattcatttctctgagtttccatttcctcatctatgaaatgtggatgataacagagcccctcaacactgtgcctggcacatgcagagtatgtgtttagtaaatactaactctttatctcttttctgaagaatgatcagtatcaaaaggcaacgatgcctatcagttccaggctgtttttgctgctcgtgactcttactgaagccctgacctatgtcgcaagtgtaagggtaaaccaaatgaaaatttggtcaaaagggtcaaatatcaacagtttcacaggactggccttagttttcaggctacatataccccctacaagagagcttatctgtggggtctcaccatccactgctgatctcagaccacaaagttttagatagagaaatcatccaagctacagaaaatgagtcacagaatgtgtaagggaattggaaaaagctgagctattaatatggcaattgtcacgtcattcctgctactataatcgactcatctctctattccttcaagcagctccccaaaacattaacccaatgacttgggaagtttgaggttctgcaatcctgtcaggaattcccctcaaactgaaattaacattgaacacgatggcaaattaaaaaatatatatattattagaacaaaaaaagtatctcaagaaagatcttacagacttaattccaacacgaatccttactgttactgcgaagagatttacaaagagaaaaatgaaggtaaatacacacacacacacacacacacacacacacacacacacagattctggttcctgatcaataacacaggaaacatttattgaactcctcacaaccaactaagtcaacaggttttattccctcagtttaccctggagagtgatggaaatcaggacagtgttggaagataacaagctggggcctgggacccagggttcttgtgagcccagggcctgcgctcttaggatctgtacctcaccgaaacctgttctctaactactgcctgtaacaggagggaaactgattagggatagcggtgtagggtatgatgccaaagaaagcaagttttcggtcagttttcaacaaagagcagattgcgttgatatgcttcaggagaacatctgtgatgtctccatgaattactgcatgggtacaatcttggaagtctttatgcgaggatgaaagtactgtagttttacagtaggacagcagcgtctatgtgggcgtttagattttattttgaactctggagatcagtgttctctctcctctagcctttgaccacataaattaaaggttaaaaaaaatcggctcaactcaactggccaaagtcaagctgaggccttccttttaatcactatcaatactggagcgcctccacccccaatttctgtggccggtggacgtttggaggtttttcttaaggtctttttcacttcaagaatggagacgcgcttggttccgaaatacaatgaagactcttggaacaaaggtgtctgcaggtttctgaacctcaccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcggggtctgaagctgggggcctagagcaactagcttcttggaaagcgactgcaattatttggggtaatatactctgttccagagacgtccaccccccacctcccacaaaaaaaaaccctgcacttaatttaaatgttacgttatatatacatcccatcatatacatatattcacacataatcactatgtaacagtccaggaagaaatttaatatttgggtaaattacatattcacacatcttcacataagtaaaaccagggtatccagacaaaaaaacaatctactaacctatatctgtttcccataggtcatatctggtctgggggtaaataaatacttctgacctcacttactgttgttatttacaaaagccaagaacagaagatgacacttggccattccctgctgttctcagagaacagcagtttcctaaagtgtcctttaaaaacataaatgggagccagcatccagcaaatcaccgggcgctgcgaaatgccttcctaaaaatacaatcttatcaaaggtctccgaaggcgtggagttaaaactacagcaaatggccttgaacttgtatttgcacacagccctggagaaaacaccagaaatagcactgcgaggccacaattgttaaaatgtgatagggctaaatttagaagaacgtgcgtttcatttagggcaaaagacacacattcggcagcatgagcaaactccatgcttacccggttgtctactttcctgtttaaaatatccttaaggaaaaaaaaaaaactgttatagtgacattcttaaaggctgagactgtcctactttctttgtagcaagattataaaatcacgtaattagctccctctctctatgctcactgccagcaaattcggcagttacataatgcaacatttccaggaaactattatgtgatttgtcttgtcgtgtctgaaaaagcaatgacaataaggtgagaaaaagggctgatcgaatggaatgcattaaaattaggaaggtggggaggtaaacgtcacaatggttcgtcccagatttaaaaataacagctgagaacattgaaagggcgaaccccagtagtacccaagatcagaattcaatgcgagcaattcttgcttttaggttttgtagtatcgttttaaaacctgtttatttgggacgtaatatagacgtaaataacgatctaatatccaacgctgcgcctcaattaccaaatcattgcacacatacgcgcatattcccacatcagcccgcaattcttgccaacatttcaccgtgggcagattatgcaatgtatgaaaggacaaatcccacaaccttcccgagggcttgtaaaacacgctgacgacaaacagggtggaaaacgtctgtgcagacacagcccctgacacaaacaaacgccgcgcaggcattctccgaatgccgtcaccgttcacgctaccaaccctttttctcaccaagcaaattaagactattccccattcctcaaccccccattcctctcccccctacgccgccagccccagagaaggaacgagaaagaaagacactagagaggaaagagcatcttcccgctcggagagggctcagcctgcctggcgctcttctttaccaaaacatcaattttcctgaaatcaggagacattatgcaacagcagcggggggagagcgcaaaccagccaggactacgtgccggcgcgaaggcgctgcaatcaaagcagccaccttaaggtggcgagtcccatcctgacaaggcagcaaaagtttatgtaatgaatgccccgcgcgcactcgccgccgctggcgagcccagcttacagcccgaccccgcacacagcgcggcccgcaccccgcgcccgcccgcccgcccgcagcgcgccctgggagcggtcgccgggcccccggccggcggtgggcggagcgcttaccgtgttcctgctctcgggccggcgaggagaaagaaaggggcggccgggagtcgggccgccggcgctcggggctcgggccgggccgggcctccggggccgcggcgggaggcgggcggcggcgagggcgcggcgcgggaggcgggcgggcgcgccgggtccgcgggcgccgtggccgcgcggagagatgtgtgttagtaggtcagttccgagcgccgcgctacgt

SEQ ID NO: 265 - DNA, 111 bp, Homo sapiens
  source 1..111: mol_type = genomic DNA
cttttgctgtcagtttttctgttgcttgtcttggttttatgccttttatatcaaggcacataaaaggcataaaaccaagacaagcaacaaaaaaaggattgatcacagaag

SEQ ID NO: 266 - DNA, 79 bp, Homo sapiens
  source 1..79: mol_type = genomic DNA
ttctgttgcttgtcttggttttatgccttttatatcaaggcacataaaaggcataaaaccaagacaagcaacaaaaaaa

SEQ ID NO: 267 - DNA, 989814 bp, Homo sapiens
  source 1..989814: mol_type = genomic DNA
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggtatttacctgacttaatgggactccagtaacccgagtcttcctagtgtagcccccttagattagataaaaaaggatactcagacaagcccttttataaggtgtttaaaagctagtggcaaacaattgacttagaggttggttaagcccctcctccctttatcattctgagtggttacatagaatttaagattttggagcaatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgattcgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccatgttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggagtggggaggggtagcattgggagatatacctaatgctagatgacgagttagtgggtgcagcgcaccagcatggcacatgtatacgtatgtaactaacctgcacaatgtgcacatgtaccctaaaacttaaagtataataataaaaaaaaaaaaagtgcagtgttactctactctgtaggagggaagtggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacctctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctgttgtgagaattaaaatatataaatgggatagtatatgtaaaagtacctaattcagaaaatgtgtgacttccattatagggggcaaaagcatccttcccttcatggtgagttgttgatacacattcaagtgaaagccagtggagattttcagacctgtattggtgatgcaatagcatgttcagcacttcttggcctcttaattgaaaagcctattggaggaagagtgggattgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttagatggctagcttcaaagaattttttctctaggtcaaaatttattaactcaaataattataaaaataaaagtaagccacaaatatccctgttaagtggttaaagcttgagctttgtaagcagggagtcctgagtttagtcctgtttccctcaattattagctctatgaccattaagtcacttaacctctcagtctgttttctcactagtaatgactgtttcacattttattgcagtattgtgaagagatgatggatatataaatgccatttagcagaataaaaagcatttttgaaattacagtaaaccaaatatatctgaaattacctcatttttgtgatataaagatgatatgaaactggtaagggaaagtctaacccctgcaaccgcaaaggaaaattatttactaactcactgaaatcttgattgaaaccatgaagagtttgtgtgaatgtatataagtcaaatgcatgttttccctatacagataaaaccaggattttcttgtggtgatttacccagtttacctggttataactataatggcattgcatattgtgaaagaatatcaaaacctgagattccatttattcactcacttattaaacatatataagacatctaccctttattattattagcaatacttaatatgagtaatgaatgcaaagaaaatcagtcatgaattttgtagtcaagtagcttgtggtctggctgcagagataaggtatgtaaacaaataataaaaaatacaagagagtaagataaatggtaacaggatagaaatggagtgccaagtgtttgagtaaagactgctgagaagatctggttgctgaagggccttaaaagtaaagggaatatcgtgaacaaaggtacaagattaggatgaagagtgagaagttggtgccagaagttaaaaccaccccagaatgaggggacattaaagaaattcaaaggtctaaagtggttaagtaataattcaaatggttctttttttttctgccctagtttatatgacttactgccaacagtacccatggctcagtgaggcttcatacttatagaggtggtagggtatgaatcagaatctccttagagtcctgagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaatttttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaacaagattaaagtggccctgggtcatgtgtcttggtcgagacttacctgtgtctctgaattgtgtttctggatcccagtgtcagctgtgactgtcacgaggctcagaggaatgactcttaccctgtgacttttggttgtttatctcaaccaggtgttgccctcattgtatggcgtactcaaaagaaacagtcataccctatgcaatatgcaggctggttggtagtcactcatggacgaagaccatgttgaatgctatggtgcacactcccaaaagcagatggtttactaggactttacaaaatgcctttcttcctacttctgcctatgccctatgccactatgccccctgaccaaaaaaaaaaaaaaaaaaaaaaaaaaattcctgatcctaagggttatagggaaaagcatccatgctatagccaaggagttctttcaaagccaacttaagcactgggtcctcaaaccctataaagcaactgttggcacgggagagaacctaatcctgattatatgtatttgcaactctggaggaagaatcttacacatatgagcaggatcgagaggaccttccctcctccccaacccctccccacaccaccaccaaatgatatacggtagccaccaaaaggaaaataaaataaacttggatactgggggaaagaaacaaaaaactaaaacagaggttcacaatttgacccaattggaaatccaaaattaaagaatttttgcaacaacaacaaaacaagataaaaggttactatttggcttttgtacctctacaacctaggttccgaattaacttttaacatttgctgaaatgcaccagttgtcaacccttcatagccttaatattgggcttcaaattatacctggaattcccctaaatttaaacaaagtacccctataatcttagggtagttaactgaggatattttaggacatgttaggaagacaaatagatatgcctcatcttaatcagaactattgccctgcctaaattcccccatagccatagcacccattaacttaaaatatcccatagtgggcatggatgctctaacccaatgagtaataaattaaaattgaattaagtctttggcacttacaaatcagcttgccaaaatgggacggcatggaccttcccctcctccgttagttaaaatagttaatatggcccaatttaaattaaaacagagtctttgaggtttgaaacccatataccagacctatttggagaagagtgactatccccactgcttcaccattaatggcccaatgtagcctgttcagaaacctagaaagaatgaatggcatctcacagtagattattgccatgttaatgctgaagttctatccaataaggctcccatatcaaatattatcaaaattactaactttaatcaacaactggtaaatacttttaattcatagatttggctaatattttagcagcgactcagccacaatttgccttcaccatcaaagggatgcagtatccttttactcagctactcatgggataacaacagccaggtcttcacacagcctgcagacaagatcttgaccacatttaactttcttcaggagcacagtaaacactgatcatactgatcacatcatcctccaagaaggttcatttggcacactcactgaggacacatatagtcataatcataaaagagctcacgaaaaagggatggaccactaccccacacaaattaccaagtccttccaccttggataaattcctgaaagctatttagctgagggccattctatccctgacacttgccagaaacagcattcgcaatttttttaaaagcccaatatgttttagtctattttgagttctggagacagcatatttctcatttacaaattttacttaaacccgtttatactattacttaagctcacttatgaattataatacaggcactgcaattagtgacccctgagagtcctttacttaaaggctttagcaacctcctcccatgattcctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtaaagggagtttctccactttatagatggtatcactaccattgtatgtgatggagcttgctggaaagttcctgatttttagcccataactgggacatccctgataatgaaacaggacccaagtcagcacaactggccaaactttatgcggtccttttagcactgaataccctgaccaacatctgcacagttctatagactgttgaaccactgccagtgatttgctcatctgctccagccaatagcagcaaaaacagttttctatccaaggttgcctctttgggttaaataactctgtgactctcttgcctcatatatatatacttatactcaaagtataagtcaaggtcatttctactcacaataaatccacaataaaaggcctcattaacactttaaccccttcagtagtctagaaattattgatagtgactaaggcattcatttcacatctcaaaatacataatattgggctcttgtacaaggcatttaatggaactttcacctcccttaccagcctcaggctgcaggcctcatagaaagccataatggtttattttacctaaacaagttcaagttcaattaaatgaaacatgccacatttcagtcatcagtcaaatatcagggatgaatcgtaataaagattctgactccatttttggtacttgactgctaacaactttcaaattcttctacttactccctcttcttcagcttcacatctgggaaaactgatagggaagcctaggtaggcctacctttggtgccagagggaagctcaatccatgcaagccccagataatatatgagaacctccccaaccttaccctacacccctcacctcccaatccaagccagtctcctttccctgctttctcaaaccatgtttggacctgtttggaagctccctctgctctccctagaaagcttcattatgtgagtgatacatcttttcatatcttcttggtgtgtgtgtgtggtatcatcagcctcaacatctgaagcaaatgttgggtgggggtacatcccactacttctgagtgacaacagatgtttagagttaaatattgaaagaaatttcatattacgataaatgacaatttcagaccaggtgcagtgagctcacgcctgtaatcacagcattttgggaggccaaggaggggggaatcacctgaggtcgggggtttgagaccagcctgaccaacatggagaaaccctgtctctactaaaaatacaaaattagcaaggcatggtggcgcatgcctgtaatcccagctactcggggaagtctgagggaggagaatcactcgagcccaggaggtggaggttgcggtgagctgagatcacaccattgcactccagcctgggcaacaagagtgaaactccgtctcaaaaaaaaaaaaaaaaaaaaaaaagaagagaaaaaagaaagaaaattttgtaagttctgagcaaccacatgaataaagccatgtgttttgtgaaatgacgtttaatatttaaacttaaaactagtaataaatctctaaatctctcagaccccaagatatgaaacttgtttgacacatttaatgattctgtaaaagtgtaagaaatgaagttaaatgaagaatgtcatggcctgaaaggatggaaaggcattagacatgcatattaccttgcctgatccaagactcagggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtcagcctctctgaatgaaataaaatgtctctaaataaaatgtcagaaataatacaaggtatggcagcaggaaagtagcttaagaaaacaaattgcaaaagggaacatttatttttcttctggacgataccatctttttctatgacttcaatcatgtatgcagctacataccaaactgtatttttcatgtcttaccttctttttgatcaccagattggtgtatacccagctgcccattttatattgccagttgtatataccttaggaatcttagactcagtatattcaaaactgaacttggctctaccatacctgctgctccttttttatttcacctaaggaactccagcagtcactcaggcccttaagtcagaaagcttggcaccatgtctaatcattttcctcacctttcaccttctactgtcccatcatgaagttctcatcattctagccacttaatatttttcacatacattaattttttttctgaatcctcatggctgctaaattttaagctattatttttctccttgaaacactactacaactccctaactgatcctcctaactctaatctagcatctcacatatacttcctcccatcccaagtcaagccctatcccacactagccagagtcaaattctaaaatgcaaatgctaatgataatatacaaaacctttaaatgacctttaagtgctcctagcaaaggtacaactttcttaacatggtctatacatcccagtgggatttgattcctgtccatctatctttctaggtttatcttaccaccacttccatcccctctagagctttgctccatccacaatttcttttttcttatctcagggacatttttgtacatgcttttcttgcatcttggaacatttaccttctccatacccacctgtgttggcctaaatcttaccttcttcaagtgttctggaatgcccttttggatccaccttaactgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatatacctttcattgtgtgttatatgaaatatatctcaataaagctgttacgaacgtaaaaatgtgaccttgagcaagtgagtttccacgttaggaaatggagataataaatgcccagcatacctcctggcatgtaatgaattctcagtacatgtcatgtggacttgggagtcagacagtcctgagatggaatcctgtctctgcctattagcagccatgtgacctttggacacatggccttttgaattgccactcaacacacttccttggatgggggaagaaagagagagtactaatcctgtttgagtcctaatattattaactaatggttctctttgggcaattatttttcttctccatggcactccatttccaccatctatatttgttaaattaaggatctttctagttgtaaacttcaatgattctggtgccccataccccggagacttattgaatcaagatctccaaaaggagccttctttctgggcatctgtggagtaggagggaacagcaaggaagaccctaaagacaaaggaccctaaagaggaaagcctggggcctagggctggtacatcagatgaagacaactaaggccagctcctacccaatgtatcaatggtgaagttgatctctaaggcccgtctcagagctggcactctgactcagagccaaggggttgctaggaaacaagggtctagagcctgctggtcagcatcatgcaggcttacatcctgccgatcaatctccctcttttttcgctcttcctgactaagtacttctaattgttgcagggagaagagaaatgccacacaaagagaactttgggagtgcccactttggctaagtaatagtaaaatgtaaatggtaagagaatcggagcatgaaaagacagaagaaagagaaggcatgagagaataccatttgccaactctgtgcctttgggttgtatatcttacccctcactcccaaatctcagtttacttccataaagataccaattttaggaagttgtagggattaaatgaaattgtgcatgtgaaatgcccagcatatctcctggcatgtagtgaattctcagtacatggcataaggacttggaagtcagacagccctaggatggaatcctggctctaccttttattagccatgtaaccttgagcagataagttttcacattaggaagatggaaataataatttggacctcacagggttgttatgaagacaatatgagatcatgtgattaactaactcataataggaactcaacacatgtaaatcattgttgccctttcctctgtcaccttctcttccaacacacatatacgcacatatatacattcttctagaacaatataagcttggtgttcagctgtgcaaacatgctcccatgtgccctactgctgagctccaggctgtgctatctgacattctcaccttctattcccacctccaggtttaggaaaagctcaaattcaaaagctgacagattagccagggagaaacagccatgacataggaagtctggcaggaagaagacatatatcttaggctgctgtagtcaggaccagaaaaggctgtatcattatgccttttgcttgagaaaactaacagtaataataatcattattggcttaattatgtctcatgataataatgaatgatgatcataatagcatttcctcagcatttgttatatgccaggtgcagcagtaatcactttacaaacatcaattcatttaaatctcataacaatactgcaagataagcataattatacccatgttaaagataagagaattgagtcccaggaacctaaaagacctgacctaagtcacacatctagagaatggaacagatgacacatagcttcttatgtatgttgccatttgttgaaacttacacctgtcgggaggagaatgcatcaatgactgacttgtgctgagttcctgctatgagccacgtaatcacatgatctcacatcatctgcataagaatcatgtgaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaagaatcatgtgagatctaaatgtttttccagctattcccctggtatctcccaaagtggccagttgttttcacttaatttaaggcattggagattcagtcttttctatttgtgacagttctcagctgtggacagaggcaatggaagtgtctctaactacttgggagactgaggcccagtgacattcaaaggtctaacaaagaagccaatagcattccctaggagcactgaggggatgcaggtactatattgctcctaactggtccaagagacttcgccattcctaaaggtgccaggccttcctacaaatctagctttgcattgttgtctccttgcgtggagtctccttcctccccaccttcccagttggcaaatgcctactcacccttaggttcctgtttagacatcttttcctccaggaagacttcccagtccaccctcagtaggttaggggcccatctctcagccttgttccctccactccccaccctccatacacatgcacactttatgctttcctctatcacagcatttatcaaattataaagcatttattaaaaaaatctgttcacctattagtctttcccatttgactgtgggatctttgagagcagggactgtgtctcacttgccttagcctccttagcacctcatattaggggctcaaggaactactgtggaatgatagagcggtgagaaaggataaaggaaagaaatgagaggcagacagggaagaacagggccccctggggtgtggtatctgaaaggactgtctgtgagcaaggctcctctcaggttggtaggttagacctgctgataatgaccaagggaaggcaaaaacttcaatgtatgtatctgtattccctccaggccattttgttctcattaaggggctgaaggcagagagatagcaaaagctccacattcatctccagggaaattccacattcttagtgccagactgctgagagaaaagggtcctatctaacaatcctgctccctcaggccctgcatctctgtctgggactgtgactgtgacaggggaatgagtatgattttgcacctgtttgaatcagagtaactagtttacaacagtatcaatctcttgtcacttcccctaggaagacggagagtggggatggtctccagtgctttaggtaatgatgcacacacatataccccaaataatataatgagcagtctgccaatcaaagactctgccatttataagtacatgggaggctttggcaacaggtagtctttgaatttgttctaagttttctggagagggaaggccaaaccatgtttctacctggttattaaatttctcccttcaccactgcaatttctaattgattgcataaagctgacctcatctttcccatctgtagaatgggaatggctaaccaagataagaatggaaaacaccttacacaagtcactatttcttactgtcacacccatgacagacattgctaagtaatcactgcattcttttccactgagcagagtcctggcccagaacctcaatgcagtattccaggcagttgattgcaatgggcacataaagaaaaactcaggcctgactatgtgattgctaatgcctcttcccactctgactttgtaaggtttgactttactttataatgcagccctgaagctaagattcagaagcagattatgctgggagatactggtggtaaagagaatattttcacccctgctcaagctgaaggtctaaattccaagtcttagctttcctaatttcttttacctgtggataagagaaacaacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttatttcaataaacattattgaatgctatcaatatgccaggcactggctaggtattagccaagcaggcatggtccctgccctcacagagcttatagtgcagcaagagagaaagatgtaaactaataaatgtgaacttacaaacaggttatgtgtagcaaaggaacatcattctaagaaaataggaatgtagcaaaggatcctgacatagcctgaggcttcttgaaaggttttctgagaaagtgacatttgagttgggtgatatgaagtgatctcagcaaaaatgggaaaaaaaaatcagcagaaggccaagtgacaaaaggattgcagcttgttctaggacttgaaggaaggtcagtatgacaaaacggcagaaagcacggagacacacagggctgaagaggttggctgaggacagatcagaactgttagagccctgaggccatgggaaggaatttgcaaattatcctcacggcagtgacaaggcacctagaagttttaatccaaggaataacatgatgggatctctattttagaaacatcctataatggttaatttcatgcgttaacttggctgggttatcaaactatttggtcaaatagtattctggttatgtatgtgaggatgattttggagagattaacatttgaattggtagactgactaagcagattgtcctccttaatgtgagtggacttaaaccagtaagttgaaggccccaatagaaccaaaaggttgaccctcccacctgaatgtcttgagctaggacattggttttttcctgcctctggactccaatggaaacatcttcttttgttggatctcaagcctgccagccttcggactggaactatagcattggctctcccacttctcagggctttggattcacactggaattacaccatctgctctcctaggtctccagcttgctgactgcagatgttggaacttctcagcctcaataattatgttagacaatttattataataaatctatatcatctatatctatatttacatatctatacctgtatctgtacatatatatatatatatctgcctataagtctctcgctacatatccatcctgttggttctgtttctctggttttgttatcctggctaatacacatcctcagggctgccgtgtggttaggattcagggaggcagggtagatgcaggctgaccaggcaagagaacaaagctggaatccagacaagctatgatggtgacttggaatagggtggcaacagtgaggaagaaaaaagtgggcaaatttaagagttatttgagaattaaaattgacagaacttgaaatggtttggaaatgggtggctgaaatcagcagaagaccttctcagaaactaaggtacaaagggagagggaagggatagttagccaactcccaccaccacagacaaatgcagccaggctgagatttttcaccttggataaaattaaggagttaagattcagaggtgactgtcctgggatcaagcaatttgaagtcagtgctctcagatcttgagagagggtgttgagaaggattcctaggtttctggttctgcttctaaacagataatggtgcttctcactagaacactagaaaagtattaggttgtgtggagtggagtttgggcaggcaagagaactagaatgatagcaaatatcagaggaaagcttgatgttggaggtataaagtagaactcatcagtgtggggattacaacagagatcatgaccatagaaacaagtctagaaagaggggtccataagacaggctcctgtgaaacttcacttactaatgttgcagaagaggatgaacctgcagaggagacagagatgcaacagtccagaggggaagtagaaaatcatgaagatctagtatcaccgaaacaaacacagaaagtgcctcacacaggaagcagacaactttgtcaaagcctactgaaaggtcaagcaagatggaacccgaaaactgtccgcaggatattgaatcactgaggaagtaaaccaagaccttgcaggtctcagaccctaagaacaactccgttcatatcttgttgccatcttaaaagcaagttccctcgggaaactgaaggctctggagaattatccagctctcatcagccccttggccacatctgtcctcaaagaaaaggcgacagttgaataatcattcccttctcctcctccacccacaacccctgagatgccttttaaacagccaaaaactcctttaaaaagtagtctgggaatgtttcagctgacattcaaaagcacattgtaattcaaatggaagtgcagaaatgcaatcccttggacagtctaggaaaatgataatagagataagacaccttttaaaagtggcgacatgtatttatctgtggggacatttctataccatggactctcccaatctaaactcaggagcagtgcaaacttcacatagagaatgtccttccacaggggtcacctaggcagtacacttggaaaagacatgttaattgcatagcattctttcacttctagcctctctttatctcgccatttctctttgtggattttggtgtgcctttgtctatctctctttgtttttctgtctcctcctcccctcccctcttttctctctctctctctctctgcctttcttttcctctctttcttgctctagctctctgtccctccctctctctcacacacacacacagaatgaacaattctttcacatacacacatctgtcaccttccatagtcagtttctctataaaaaagaagcaattaaaaattcaaaaaacttattatatttctaattcctgcatctatcactatcctccctaagtagagaatgacaggggatgataaaagttacagattccttttgatatctccccagtccagttccacagctctttcccttcactggctccaagcctgtagctaaactcactgaggcccctcccaatcccaggacaatctacctctgcccttgatcctgggtcacaacgatgacaagggatgagagcaaattagcaagccccacccctgcccacacacatgtgtgccttcacgcacatacatacacacaaacatacacacctgggaacacagtaatcgaagtggatgtggcagccttgggtggagggcatgggttggatcaagataattaggccctcaactcagagctggatgggtccatccattgctctattttcttattccatctatacaatgactttgcattttgcatatggaaaaactgatcttaaagaatgaatcactttgctcaagatcacacatctgggaagaggtagagctgggatttgaattgagatccatctgattgtaaaacctgtgctttatctccaaatgagaaagtctttatccaaggtagccacaggaagggtgactttatacagtgaaccctcatcatgatataaagctcatgtatcatgatcacagctagggagaatgcgtgaatatcaagtcaaagggtgaaatggagccccagtgggaagaaggtagttttttcaaaatacagggatatcaagagcacagaagcatgtaatgaaagtattatgctagaggaagagactcagaagttcacacactgcttgggggaatggcacgggagcagaggtgatggctaaagaaacctgacaggctaaacagcttccatgctaatcatgtctggaacctagagcttccagggatgactttggctgctctagttgtttcctaaggcccagttcttcctgcattagattctaccttattgacctgttcggtgttccagtcccctacggactactggaaagctcagaattcccacctggtgatataaaactctgccttcctgcctggagatcttaccagtggttattggcatgcccagtgccccctctggaatcaacatcaaaaactaggtctgttattctagcttttatttttgccctattacagggaagaaaatacagaggatctagaccactatacttcctttctgtgtctagaatagacattaccaactgatcatctcaatgatcccaataacttacacacagtgttctagacaagccattccctagttgatcagaattggcacatgaaagctagagagcataatatgatagtgactgggtattccaaccagcctggaaatgttggcctcctccctcttcccagctgtctaccagtggatttttaaaagtctgtaacaaaaatgatgaaatattgggatactaaggcatgctggtaatgaacaacgtaggaacagagcctatatcttctttatttggtgccacaacatctgacgcacacacaaaaaaaaatacagagaaaaagcagttgggaaatgttcagacaatcaatgaataactatgactttattttcccacacaatgtacctttagaaacacttaggggaatgagagtaaagtaaactcctcatgggaaatattttaatcaggcacattcaccccatctcccttggctttccagtaatttccagtggtttccccagatcataaaagtggccagggtcccatcattatgaaacctgggaaggctagggcatttgtttctaatatccagggacaccagagctagggtgaaggaagaactgggctgaagtttggattcaaataccatcttcttggccttttgcctctgtaagttaaggtttccctcctgtaatgggggaagtgagtacccttgcctcctttgctttctggggtagatgggaagatcacaggaaggccatctggaaactgtagagggctgtacaaatgctcatggttgttatccatgccctatttggtctattttccccaacctactctaccgagtttgaccctccactcctcccttcactaagagttaaaatgacacttacaggattgtctttatctagtgacatctgtaattcacagataaaaatgagggtagaggctgggcgctgtggcttacgcctgtaatctcagcactttgggaggctgagatgggcggatcatgaggtcaggagattgagactatcctggctaacacagtgaaaccccatctctactaaaaatagaaaaaattagccgggcatggtggcgggcgcctgtagtcccagctactccggggactgaggcaggagaatggcgtgaacccggaaagcagagctttcagtgagcagagatcgtgccactgagctccagcctgggtgacagactgagactccgtctcaaaaaaaaaaaatgagggttgacctcacacattagcaaggtatggagctgggactagaatcctcagccaatgcccacaatttttactttatttcaagctactgttttctatgtacctactatgtaccagacattttacctacatcatctcattttattctcccaaaagccatgcaagagaattactatccctcatttaacacatgaggaaactgagacttagaagttcctttacctgaggttacctgccaggtgtgtagaaagaggagtaaagacatgaaacaccctccatcccacttcagcactgcactatctctcctcctctcacaagttctgcccaccgagttatcagcctccaagcccagattcatcctggcctggtttccaacgtttagcagatggcagtgacacataactcatggccggggagaaaaggggatactagctatctttaagtccaaaggcttctttcaactctacagatgcatatccccagcttctcatctcccattccctagcatcactcccaaatataaaaaataaaaccggagtatttgatctaccatctaggtggtcacagcaggtgaagatggaggggaagaaacacacacagaatggttaagctgacctcaatgcatcctctgtccttttcttgggagcaagtatggacgatggaagcaagaaaagtgcctttgcagactagaagcccaggaaggaaaacaccaagtttaccccacaagtttgcggcaaagccaggtcttgagggggacccctccagctgttgtttcagcactctttcttcccctctcccatcttacttgtaacagattccatgatccaccatacaaggaatgggattttctggaatgagaaagtcaagtctaaagtctgaagacagctaaggatggagaaggggtgggatttagaatcagagtagtgtcccaagccccaaacgtggtatgaagcaaattagttatgtagccacagtgagtgaaggtttttataaacataacctaatagtattacttcaaagtcctgaagcttattgccctgcttaatgatgtgtcacattatttgtagggtagcacaatgagacttctattgatttaatgcacttccttaaagactgtcattgacacagccataaaacggagctattcccagacaactcaattatatccactgtgcccataaaccaccccgtgccccacacagttgcacacaggaagcagaaagggctgagagcacgactggggatgcaaagcccccagggacaaaagggaagggatctagagattgggaagcaggtggactagggttttatccagttgggaatgtgcagctgcataaaaagcactagacaggaggtgtagagcaccccacttggtcttggccctgccaagcaaagctgcgtgaaagctcccttcttctcccctatagacttagtttcctcgactgcaaaactggagtgctatgctcaatgagatccttcagatccctcctggctcccacattttgtggttttttgttatgattgcttttgttcttggagatagggtggctgagctgtatgaaaagatgcaagcatgtttttaacattgctcttcaccctttccatcaattgagagactttcttttacaaatagttgataataatagtattaactatatcaagaagcatttcagtatagttgaaagagggaaagaacatgggcttttgcagccagccagccttgggttccaatcctgaccctgctacttattagctgtgtgtctatgagtacttgatgtggcatatctgagactcattttctcatgtgtaaaatgggagtatgaatacactgacctattaaaacacatatatacacatgtgcgatattctaacttcctcaaaatgctattacataaaccacttatctttaatgtgagaagcagacaagaatagctacttacgtacccatttcacaggaagagaaaattgaggtggaaaaggaataaccttcacaaggtgagtgggcagagactggtctccagcacctggtctgaggaattccaattctgataatagctgagagtcagaggaaaatgaaatctgctggcccttcctgaggataaaagcctcaccacaggacagaatggaaaccgtctgcttggttatgaggtgattgtttttccaaaggaattgagttcttcttgggagagaagaacccaagatcttcttgggttctcccaagaagcctggagagaagaaagtgtcaagaagacaccacttgctgacccccaacctgatctctggcagttgtttcaaagagaggatgtgggaagcaaagtacctgcaagagaaggcaagggttctggagtctagaacactaacttgaggcctcagaaaatgcctgacttgagagaatcctgcaaaatcattatacgatccctcactctgcccatggtgaaactgaagctcagagagaggcagggacttgcccatggtcacacagcttagacgtggcagagccaggatttagatccaaggcagctcagttgtctccccagaccccttgcctctatagcctgcctggccacctcctacagtaggcactccgggcttacctttctgatactggagccacagctgctgctggaccttcttgctgggaaagtggatgatgcaggtgagctctgagccatagagggcctctgcgatgtagtgggagccatagtgctggatgaaggacagcagctcctcccgactgctctccttggtcaggatcttgagaacattagtgaagcctggacaagagaggagcatgtggaggtggtcagatgtgagaggctggcggctagcaaattatacggtggcaggagttcttcccaacctgtattttgtgccttacccctcagcacagtggcagcttggtggctgcactagtccaaacatatacataattccctcacttaaatagcaatgaatgccctctctgaggggtacatcagacacggtgaccaagagggaatctgcaggagaagaaggcctaaactcagcaacgtagaccatgggaacttaaaaaagataaatcaagaagtcaaagctgatatccactcactgagcaaccaatgtgtactgggaaaactgttagatgtttcaccctctttatgtaacttaaccttagccacaatcatatataatttgacaacaacaacacccattgtataatgagcaagtcaaagctgagagactaaaattgagttatcttgaacttccaggtagagaaagaagctggactcaaacccacttatgttctcactgcacactgcatgcattttccaccacaccaaacaaaccagggcttgaactgcccatggctggaatcctaaggctgcatttgcccagagtcagcatgtattctgagtccatgaatctgattcctggtttagcttcctgtagcattgcttttctttatatctctgctgttccctctctttaacagtggtatgttctctctccctagatttccacagagccttcttgctgctctatttcttagtcctaggctaagtcctcagcacttaacatggggcctgcacagcagtcactcagtaaaaactgctccctctttctctccttcctcaaacaggcacatgagcaagctattcttccagggacattcctgagctcctccctgctactggacaaagcctagtgaccttctttagaaattcaaggttccaagctcatctctaatgagccacccacactaagttttagctccagccaaattagttttattatttatcctgaatgtgacctgaaatttctatcattctatctttccttgcattctcactacactcaacacacacacacacacacacacacacacacacacacacacacctgaaatggcctccctatgtcctccctaagtcacacctatgcttcaaggcccctggaagtcacctcttctccaagaagcctttcacatcattatggacaggagtgcctactgtctgcactttcaacatgcaccaccttaaagtcggaagctctaccttatttgtctctatatccgcacatgcatcctccctgcacacccaccccaactgggtacatggcccagttcctgggacacagcaaacacaccaaccacaattattacaagaacagccaacactgtgccacatcaaagtaaaatgtaaaagaacaagcttctctccagcattaaaagtgagctccaatttgccaacatttgattgacaaaagggttttccgggagcatcattattgattaattaaagcagatgcacctttgtacttctaacaggaacatcatagtcttattcacaaatgcagtgtggggtgtggggggcagaaaacaaaaatagggggctcaaagaatgggtgtttgatgagaacaacccctctccatcaacctgttaagtaatacaactgggtaattaatacagtagtgttaataacgagatggtttctgttaagtaataaaaaacaataccacagagatgccctgagggtcttatccaggcagacaaaactgcaatcaaatccttgattcattcattccctgctctgccacttactagctgtgtgaccttgggcaagttatttaacctccctaaccctcagtatacttatctgaagaaaaatgggataaataatgtcttcctcacagtactgttctgtcataagaaatgaactattataaaatgcttaacagatgtcagcaataattactatttctacttcccagagggtgaaatcctccaattcccaggctgtaagagcttcattttgctgatgaacaaagaaaagagaacaaaagacctcatagataattagaggacactcagacaataaaccagtgaaagtgttattagtaagagttagggtagaatatcctaggtcaggcctcatctttccagattccttcattcattccttatttttcagtcttcatttatttttaaaaattcctccatcatacatgagcaccaacaacgtgctaatctttgttagttttggagatactggaataaataagacccaagccccgcccacagttctcaggtcatagacaagattccaatataaatcaaggacttgttaatgtcttgatatagatatttaagcaccgagaattccgtgagttgttttgaggggaatggagaacgggggaggcatcacagagtaatatagtatatgttcccaagacaaagaggtccaggcagagggaacggtatgggcaaagtcactgtggcatgagagaacatgcaccattttgggcactataaattgttgccatctgttggagcttaaagttcatgtggatataatgtgggtggtgcatgtaaagggatgggggtgtgggggttatataagatttttgtatcggagatggacaggaaaataaattagccaggagagaaagagaaattggtgtctgaggagaatttataattcacaagcttgaaatacttcaaaaacataaatatgacttagatactgtttatccctactctcctattcatccctccacaccctactcagataccttttcctccaggaagcctctctagctcccccagaatgattagctccatcttctgtgccaccgcttccccattattgcatcgaccctactgtctgtcagactcctgtccacccaccctccctaggactccttgatggcagagaggatgcatcctcatttcctcagcatccccagtgctctcatatgccctggcacatgctaggtccttggcaacaagtgctaaattattccaagtcccctggctgcccaggcagtggtcctcacctgctgcgagggtgatggtgctgagcttcacacggtagaggttgctccggacccgccactgctgcaccatggggtaacccatggcctcatcatacctgatatctcctgggagagaaaataagatggtcacgtgagcccagaattaagacgcttcacaccacattgttcaccctgcagctcttggctctgggaaacagacacctctttgaagtacaactttcactgggattgacaattttatgaaccccaccctccaggcctctttctggtctctaatctcagccctacccctcatttttctctctgctctatagcttgcaagtcccctttaccctacaagcaagagcaacctcaggtcagatctatgtcttacctaaccccatttgcaatttgccaccaggcactagacatcccagtgcttcagtttccacatctgacactgtagctctctctaatactcttatttcgtaggcatgttgtgaggctcaagtaaggtaccagaagtgggagccctctggtaacctagaaatgttgtgcatgtagaccacatgtaagtaaactacagcctatttgttatgtattttctgtagctgctttcacactatgacagcagagttgagcagttgcaatacaaaccacctgcaaaggctaatgcatttattaactttcccttcatgtttgctgacccctatgtagactatcatttcttaacatggaaacatggatgttcataagtattatgtaaaatatacgtatacagaaataaactctttctatttcaagtaagactgagaagcacaggcaaaacaaagtttaactgtataatttctcagcatcttgattatattaatatgcatgaaagtagtgtgcaaacttctttgaccataaaaccccttttgtatgaaaggtcctttggaattcatgttttatagaataaatttcaggaaacactggtgtaaacaagaaataaaaacagaaaagacacaacgaagtgttagcaaatgattaactttgggcggtggtaaatgaaaaattcttgttttctgacttatattcacatctattttctaaattttctaccctaagctttgcaaactctcttttttataagctgaacaaaaatacattaaaaagatgctagtcacatcagcagttattattactgtttttatgtatccacactttcttgtgcctctgcaaatggcaggcacattttctatccttttctcttgtcccctggtgagtaggcacttaaagagatatttgataccaagattaaaatgagaatctcattggaacaaatgatttcttcctggacattactgcagtattaaagttgtccattactgtcaactttttttttttcctccttatgctccttagccttttcaggaataaaatagttttttagaggctttcattttaaagtaaaatattcatgatccccaaagatatgtccactggagtgaggttgtttgttataaatacatcctctttgtttatctgctctgcctctcctggccttcctttgcagaggctagggagaaaaggagattgtgtggagggaggaagggagggctatgtttttgactaagggcagagaaaatgtctgcacaagaagattcagacaccagggacaaggcagtctctgctccttccattactgctcattcatgttcaaagcagacttgctgggggcattggcagccaaggcctatctccaacagaagaggcagaatgatgcaggctgttgagaggcagctctttcacttggtggcatgatgtccaaacataaaaacaaaacaaatttaaaaactccttctgattatcaagtaatttgtaaaaccatcttctcactccatccctcacttccttccatctctgctcattcctggattcatgcctgaaataaaagcttctccaatggaatggatgtcagctttttgaggtcaaggtcacggtctatattcctccccttctacagagcctagaagagagcctggcttatagtagcctctcaataaatgcctatccactggcggcctaactctcactctgttcctaaccataaactcatccctgggttactctatcgctgactctcatcttgccctccccatctcagctccccacctggggattatggttggaatgaagctatgtgatggagggaggaatttttcctggtaataataataataataataataataataataataataataataataaatcttttgaaatgcaacagttccctttattaggaaatctccaaggatccttgagtcaaaacaaagaatcataacaatttgaaccactaatggatacccatagtgtgccaagcattttatatacatgatctttatttctcattagaatcctaaaaaaaaattatcataccctatttttttgttattgtgttttgttttgttttgttttgtttttgagacagagtttcactcctgttgcccatgctggagtgcagtggcaagatctcggctcactgcaacctccacctcctgggttcaagtgattctcctgcctcggcctcttgagtagttggaattacaggcacccaccaccacccctggctaattttttgtatctttagtagagacggggtttcatcatgttggctaggctggtctcaaactcctgacctcaggtgatcaacctgcctcggactcccaaagtgtggggattacaggcatgagccactgcgcccggcccataccctatattttagaggaagaaactgaggctcagagagcaaaactgtccaaggacataccaggatcaatgacaggttcaggggcctttccattaaagcacagcacctcctcacagaccgtggacatgtctgctttaggaggtagtaaactccccatcactgggggtatccaaagagggataaccactcaggaaggatattatagacttgattcctcattaggagggaagattagactagacaccttttgcagtccatgttagctccgaaattttatgatcttaaaaaaaatgaaaattaaggaaggcatagaaatttttgtaacattttacaaggtgtcttttacatccatcatttcatttgatctacatctgggtccctctttgaaatagcacaggtcaggggtgatgtaagatagtggatatgccatcagctttggagtcaagaccgactttgtttaaatcttgacatgactatagactagccacgtggccttggattagttcatgtccttgctaacaagtttaaaggggacaataatggccttgcagggttacatggtttaacacacaaaaagtgcctggcccccaggaccccttaagcacatgtgggttctctcctccatctatgctcttttacaggaaaggctcacgggagttagatgactcttttgaggtttcccagagcttgcaagtgatggggaagtcagacagagatttcaacctaggtctgtgagattgtggggtcttccctggggaacaattcccctctcagtgaaagagctctattatccttccccatgacgattcccccgtgactattctccctgggcagtggataaggcacacaaccacagtatcacaaaggcagagtcgagaacctcacatcttaggaaatttcttaagaaaagggtaggagaggaactgggagcaaaaaaagaggaaagagcatcctggggttggacagaaaatatggagtctcaggaaagcctgcaaaaggcaacttcccagtggagagagaaagtggttgcaggggtgggggagcggcaaagtggagtagaaagggcaaaagacttggtgctacagcacccaggttttagtcctggcagatatgctgtgtaactttggactggtcccttctacctctctaagtatagcttcctaatctatcaaatggtaaaaataatacccaccccacagatggcacagtgcccacgtacaaaaacgagctgtgtaactcgagtgctttcaagtaggaggggctcctgattggagagtccacttcttttactttggaatgacttaaaacgaaccaagaaaacaaaatactaacagtggaaaaataccagaaaattgtcaatgagaatgaaaagtgttttgagactcattcacagaggcaaaactctcactgagaaaaatcgttcctgttctcacagaggaacctcctctcaaagatgactgcagtcccaagtctgaggtctcagggaagtccctggttctgctcagccaatagcaggagcccaagaaagggtaagttccttcccatacccttcctcatgaaggaggaggcttgacagagcccatcttggatctgctgaagactgatatgcactaggtgtggagactcggtgtgtggtcagggaacctgggaagggtctggcacatgtgtcttaccagtgagcagttggaggtctggaaggggctcggagaggaccccccggcactgctcctccaccggcagcgggatcaccaacagcccatcggccagctggggaaagtccttgatgaagttgttctccctgtggagaggagcagagagactgccaaatcgaggaagtggagactgctgaggactacagggcaaggaggcaggatgctgtagtcagaataaagactcatggtggggtgactttgctgtaatgcctctggtttcctgaatcccagctctgagaacatggtgctaactacaggttcctgaatcaggcaggctggggttcaaatttagccccactgcttacttggctgtatgatctcaagcatgctactgttcctctcagaacctcagtttccttgtctataaagtgagactcagatctaagggctgttgtaagcacttaatgggaaaaacctaccaattatttaagatactttctgatgctctataaactgtatgtggccgctaaatgtcccctggcataagcagtggcaatgttgaaccaggatgtgagaactgagaatagtgcgtagtgtttgcagaacaaggggcaagactaggctgaaaaaaagaaaaacaaacaaacaaaccttggaaaaaatagatgtttgttaaatggaagggccctaagagacttttttttttggctcaaacttttccttttacagatggggaaactgaggcctggagaaagggaatgacttgctgaatcacaacctgataggttagactcaaacccatgtcttctgactccaggttagtgctctttcccttgctctaacttctttaggtgcctctaaccctttcctgcaggccagtcccagggaacagaagacagacctctgaatgaccccagaaaactgaactgtgaacaaagttctgagaggatggtagtaacagtgcagcagagggaggcaggtttcattcttctagacaatagacctgcctaaaaattaacagcctgccaagagaggtggtgagcttcctgttactgagggtgtgcaagcagaaaacttggcagccagttggcacggatggtatcgaggtcttttccaaattaaatatgacttatgaggtccctttatattcagaaattcccagcattaaagacatgaattatagtctggagaggaggaggagagaagagaagggggaggagaagaacaaaaggaggaagatgtttattacttcattttgacacatggaatggtcaaccttgaaatgaaaatcagaagcacgaaaacaaaaatatgtgatgccaaagcaatgcctttgaagcctgtatctcagacagttcaaaagcagctgtaaaagtgttgagtggcttgggtcaccttcctgtctgctcaacatctctgcaccccactccaggcacctttgaagctcatcatcaattcatccatttaatgaacactttcttcatttctgagtccagaggatgtgacattatcaccatcttctataccaccagcatcaccatcattatcatcattgtctttgtcatctatattattcattgaatctttataatttgctaggatctagctaaatactttacatacattttatcacttaatcttcacagcaatcccaaaagatagatattattatctttaagttgcagacaagtagcatgagatttggtgttaacaggtggtggagctgggatacgaacccaggtctggttgggcctaagactgtctgcccaggcatgcacgtgcatgatggtgagttttaaggcccacacttgccatttaaacatgctgctgtgtgtgggtgtgccatggctgtctgtggagtcatccttgtttatgtctgtgtgtgcctgtgataatgggttctacctagatggttggtctttgtctacaaatctgggagtgtggaacagcaatatgaatttaaaaagacaggcttctggtagatggaagtaccaccacatagcatataaccctagccaggactaaatgtcctcatgcttcccttgtgaggtggcctctggtgatagatttttccctgaaagatgtagcaggatggaggggtagtccatgccctagtcattcaaccagcatgcactgagcacatacttgggtggaatcctgtgctgggtggtgctaagaacacagagacagattgatgtttccccttgtcctctagatcttctcagcctagtggggaaaacacaaaaaatggccatgcagaataatcagtgggggctgctatcaggaattctgcatgtgctgggtgctgctgcacaaggtctcttccctacaagatccccagcacttgttttcactctgggcaggagaggctaagggtgaggaggtagctcagccttggaagctgagaagagcctatgaggactgggctccagttctgcccacactgcatcctagctgtgtaacctggagcaaaccaaccaaatctcaaggttctgttctgtaaaatggggatcataacagctattcagctggccttagtggaatggctacaataacaatagccttttattgagcacctactatgcaccagacacaattggcagtacttattcttcacccaactctgtgaagtaggtgtcatttacattccccattcagacattgaaaagctgaagcacaaagaagttatgtaactacctaaagccacaaggctgggaagtgggagatcccaggtggtttggccccagatcaaaattgagtaatatattgctttcaaccatgagttaagttttaaagttgattcaatctgatatttaaattttccagaattctatgaggtttaaaagcaaactaaatgcttaagtatattttatactttattatgtactaaaaaatgaccagattgtggtgttatttctcagcttgcctttccctaagcattcactcagaaagttgaatatagaagggttaatatttattgtatgcctggcatagagtctttgtttgtctaacaggtcatggtagatgtcttcaaaagacatcctagcactcctcatcactgcttgggtagagggtgctaaaggacctgcctgtgacacacacagactgtcagtgttggaagggccatagtgcctgggcgtgtgctgagcccagacaggatgcagccaagaggaggaccttgctgctcctacaagagaggagagagttagctattcaccacatgccccaggctctgttctctatgtgacctcttcaagcctcacgcaaatgccacaaaataggcatatattcccagtttaaccgacaaggaaatggattttccatggacttacataatggatgcatttgggaaatgaaatctgaaggcaaatctatcatttttcactttaccacccaagagtgtccatttcaaatctctagaaatgttcttacaattgtagagaagggaaggtaatgccaccttctctatccgcatgtccctctcttccaatccttctgccttcttatcaagtcactcttagctctgcaaggaaatctgaccccaacgggacaatgcaaggaagtagagtgtgcaaactcaggaggcaggggcctggctcaggacaccccttctcggaggaaggttttccttcctgagcttccagaaagtagaggggggacttggagaaatgcagaaagacagagaagatggaagggtgacagttagccagccaatatggaagactgggaagaagggtggcaggtaggcggagatgaagcccgaatgaacagcccagcgacggcatggtctctcgggtactgggtccctttgcgaccgcctgggcgatggccacaagtcctgcaaggcctctgccagcagagggcgcccggggcctttgcatcgatcagctgtttcgggaggcaaaacatggatgagagagtagctgctgggaaagttccgctgggctgagaacctcagatggaagcctagacaacagctgcagaacccacccacctgggagaggcgaccagggagctggcagggtgctggcttaaactcgggtgctcaggaataattcagattcttagcgctcgtgtgtgtgtgtgtgaatgtgtgtgtgtgtgtgtgtgtgtgtgtgtagtaaaaactaccacacaactaattcgtataataggaagacagaaataatggacaatatttatttattgattatatctgttgctcatcagttatgctgtagctcatgtgccaacgtgtgtgtgtgtgtgtgtgtgtgtgtgtgtgtgtgtgtagtaaaagctgctaggtaactaaccctagcaataatgataatatttacagagatttattgattgcatttgttgaccatctcctatactcaaggtagtgtgtcaagatatagtagcgtacaggaatggaaaaccaaaggttgtatgttctcacttataactgtgaactaagctataaggatacaaaggcataagagtgatataatgagttttgaggacttggcgggggaaggttggaagaggagtgataaaagactacatattggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaagactacatattggggccaggagcagcggctcatgcctataatcccagcactttgggaggctgaggcagaaagatcccctgaggtcaggagttcaagaccaacttggccaacatggtgaaaccccatctctactaaaaatacacaaattagctgggcatggtggcacccacctgtaatcccagctactcgggaggctgaggcatgagaatcatttgaactcgggaggcggaggttgcagtgagctgagattgcgctgagactccatctcagaagaaaaaaaaaaaaagactatgtgttgggtacagtgtctactgttcagatgaagggtgccctaaaatctcagcaatcaccactaaagaacttatctatctaatcaaaaaccacttgtacccccaaaacgatggaaattaaaacagatataggagtgtgtatgccattttaacctcataagaactctgtgagacaggtactatcattattcccactttatagacaaagaaacatgttcagagaggttaaggaacttgtccaactgaggtccatggtttgaaagtggcagtggccaagaccgcattctaacccctagcttccagctgagagcccagcacgcagtaagtacatgctcagtgaatcgatcccaagcctgtgctcttgatccctggcatagcttgactcatttagagatgagaccaggcagttctgttattcaccaccacagtggagtctgctttcaagaaagcatttttgagagatgcttgtttaaacaaacagtggctctgctgctgcttgaaacacaacattcacttacacacacacacacacacacacaaacacacagataagcatctgccaaatttatctataaaaacagttcaatctcagtcgacattctagggaaacaattcatcgattctaaaatagtagatcttgggccccggggactctggcagtgagaggtctccttcatttcacaaacacttattggagctctaacctttttcaggaactgttttgggtactagggatacagcagtggaaaatcagaggagatgcctccattcatgaagaccaggagagaatcaatgttgcattgaggtctacaagatccctcattatctagaccctgcctacttactcctgctgccttattgtttgagccacagccccctgggccactgttttcctcctgctctgactgtccttaagttccttttctggggcatgctcccatcctacacaaggacccacttagaatttgccctctctctggaatttgccctccctctggaatttgccctccctctgcacctgaacaactcctactcatcattcagaccatccactattcctctgcctttgagaactctcgctggaatcagttcttccattacacacccttatagtatcttgttgttttccactatgaagggctttatcgtttctaacgatacatgtgctcatggaagaccttgttggacacctgtctttcccactagactgtgagttccatgcagccccaaactatgcctgtccaatgtactgctgcctcctcagggcccagcagtgcaaactgagtgcctgagtaaaactgagaaaaagtaggtgcaccatgagcatttgttgaagcagtgaaggaagaaaacccagagacaatggtaatgtgtgcatgaccacatctattatgaagccctttctgatgttttgccagagtctcagaatgcttcaggatctaaagcatattgaggatttgagtctaatattccataagaagcttcaaaaccctactttcttaccctaaattcctgagtgcatacatactctggctcccatggagcttggacagaggggccaggggccactgagtgagtgggaccagatgagaaaagatgatctccctaagaaaggggttggttaaacctcccattcttggtgtgcatatgtgcattcaggtagaggtagtggtgtgggcacattctaaaatgaacaatgccagtgggcagcaaaaggccccattcaaaaaccatcatttccataataccattccagttttccccagttgaaatacatcttttctatcactttaatttcatgcatcttctttgtagattccagatgtggccttgggatctagtgatagaaagagcatgggcttagaactcatacgcacatggatacaaattctagctgtgtgaccttcaggagtatcacttcaaattttatgatccttagtgacttcatctgtaacatggggataatgagttcagcttcaatgcgtgaagaggaggatttatgtaaagttattttattttatttatttatttttttgagatggagtcttgctctgtcgcccaggctggagtgcagttgtgcgatcttggctcactgcaagctccgcctcccgggttcacgccattctcctgcctcagcctcccgagtagctgggactacaggcgcccaccaccacgctctgctaattttttaattttttttagtagagatggggtttcactgtgttagccaggatggtctctatctcctgacctcgggatctgcccgtgtcagcctctcaaagtgctgggattacaggcgtgaaccaccgcgcccggcggtaaagttatttttaatgctagcttattttcctgaatcccatactagattctgaatctctccaaggatctcagagggcccagcacagtgcctttctcactgtatatgcccctgagcatttgttgaaccatgtgtaatagaaggggaaggtctctttaccctcccaggctacctgcatatgacctctaaatgacagaaatcctacaaagcatttccactgagatgcactgtgtctagcttccttctgatcagccatgctgacagcaaagacaaacaagggaagctggactcctctgccactctgtcctacccttcctcaggtctttgctgcctgccgcccccttttaagaatatgtgtgttttgggtacattaatacacagcagccagcatgcaagagccatcacccctcagttctagggaaattagcatttaaattgaggtattccaggaaggtaaatcaccttagagccagccagcactgtctgcagtcttttcttacttgagggaaagctaggagccttggcttgggagctattgagtttgcagggaggggcttgctctccttgcctggttctctggctcttcctacactgcccataagcctcaaaaaaggttgccttaaaatcccaaagctgatgaggacatattccctggtgtacactgtgcctcatcccccctctctgactgaactgagcctttatgccaagtgacaggatgactttggctgagatttggtgtcctctgacaacaagcagttgggagacctgtgttctcatcttggctctgtcactggctggctgtgtgatgtgcagaagccactgtccttctctggaactgagaagaatgggctggtacaaaacgtttgtctgaacctcaagctgggaggtgctgggctagattttgtagctgtcctgcaggtgccggagacatctatagggtctggtggtgataaattgatgctaacactggttggttggtaccagcccaccctgaagctctgccctcttaagcagcagttagaaactgttctcatatgctctacttcttaattatgcatcatagtttaagttctctggtcaagcactcaatatttagtgattccttcatttaaccattcattcgttcattcattcattccttcattcattcaacaaatatttactgttatttgtcaggcattaggaatacaacaataaaaatgacaatctctgtcctccagttactcacaggctgataggagacgcacatgtgtacaaatgccttctatgtatgtgtgcacatgtgtgcaaggtaaatcattgttttgaaaatgttaaaatgtttttcattctccggaaatcctatttcagctttgcctctcaaagttgactttgcagtgtttcaagctggacaatagtttcaaaacccagcctgtgctgagggcgaagttcccttctctatcaaaagacagacctgctgactcagatcattatgttttattttaatatacagattgggcaggtgatggcctcacagttgtacccaccagataagaaaaggaaatagtacactcttctttctgccactgatgctgcaaggaattgttgaagaggaaagtcaagtggctgagagttcagatgggagtgcctcagtgaccctcctcctggccttttggaagtcaaaccacccctcattcattccaagtacaagggtagtgtcaataaatgcttaagatatttaagaatctcgatacgggtgagcaggggtgatagggtttgctcccctagactcaggatatagtctgggaagtttgcaagcccctcgctcaacaagccaacaggagctcctgggagagggtagcagtaagtgaagaagagacttgaatttggagccacccatgccaagttctgcatacacagggtaaaggggataaaactgtcaagacttcctggccccataaatatgtgcaattgttatatgtcaattaaaatataaaattaaaaataaaaagacttcttggcataactccttcgctcccatggtggcagggatggtagatgaggctgagattagaacattagaaccaagggggcttcagagtgttgagacctaatgaccttggacattggctgtgtgttccaacacattgcttctctcaaaaaactacccaagaccatccatacctcaatggatgccagtgccagcgctcagagccaagctcaaacaaaaaatcacatagcaaataccagcaaggatccacaagaacacatttgtaccagagaccttccctcaccaacctctgccttctctgaggccaagttaaggggtaggggagactgtttggtaagggggagaggcaaggctggtggggagaatgcaactgaggcaagactggtggggagttgaactttgagtggactaaacgtttaccctagagaaaatgttttgtatccttaatcaaaaaatggaaatacttggccgggcatggtggcttatgcctgtaatcccagcactttgggaggccgaggcaggcagatcttgaggtcaggagattgagaccatcctcgctaacatggtgaaaccccgcctctactaaaaatgcaaaaaaattagccaggcgtggtggcggacgcctgtagtccacgctactcaggaggctgaggctgaggcaggagaatggcgtgaacccaggaggcagagcttgtagtgagccgagatcatgccgctgcactccagtgagacgggatctcactctgtcgcccaggctggagtgcactggtgtgatctcggctcactgaaacctccatctcccgggttcaagcgattcgcctgcctcccgagtagctgggattacaggggtgtgccaccccaccgagctaattgtatttttagtagagacggggtttcaccatgtcagccaggctggtcttgaacccctgacctcaaataatatgcccacttcgccctcccaaagtgctgggatttcaggcgtgagccaccgtaccaggcagaaacatgtttttgctatcagtggaatgaaaacttgagagaattattatgtcagttgtagaaaattaagacaacagtgtttttgtatactgagttgcagcaaaataatttttgaatgcttgactgtgagaatggatggttataggttagagggataaagtctaagtttcatcgggaaagttcagggacaaaggaaatgaagagaaggaaaacttaatgtagactgaggaggtcaggaaggctccctggaggaggtgagacttgacagattgggaggggttaacaagggagagggcagaaaaaggaggtgagggtggggcctaggcagaaagaacagcatgcacaaaagtccataggggtgtatgtgtgtgggcgcatgtgtgtgtatggaagaggcacagataaaacacatggcatgttctggaaattgcaataagctaagtttcaagatgctaaagcagcgagtgagaagcaaggatgggatagggctagaggaggccacatagggatcagatctcatgggttttctaagtgatgctacagaaggtgggcttcattctaagggtaaggagacccactgtagggtattcagcaggaaagcaaaaccatcagataggagcttcaaaaagactgcctgactacagggtagaggatggactgaaaaaaggctggaaggagggagaccagttaagaggttttgcagtaatccagacaagacataaccgattagatggacaacagaatacagagaagaggcacagatttgagagagagtcaggaagtagaacctgctgatctccattgccaactgcacgtggtggggagtaaaagaagagtcatgggatatattgagcaggtttgagcccaagcagtcaagcccatgctcctgtgctgactccagagacctgcctccccagtatttgcttattattagtactaataaccagagccctccacacatgcctgagttcattaaccacagctagaaaacagaccaatgtgctttgtcccatcacatatgtcctcggcctcctttctgcctctgctagctgtcagtccacctcagcttaactgctaactgtgagacccacaggaagatggccagatctcaagcctaacccccagcacttcaagcaggccaagtcaccacccagacggaggctctcagaactgcaatttgctccctagcagaatgcagcttgtgacccctactgtccagggtgtttcaaggaccatggctgcaaagttgctttactggcctatccagtggcccatacccatgggtccactctaatcacatctgatgctcctagaaatgataagcattactgttaccatttgataggaaaagaagcagaggcagtatagagaagtgtcttatttaaggccttgcaggtgttttcttggcagaattggactgactaccaatccctattcttagtttccaatccagtcctgtttcgacttgtgcattctcaagggttaggcagagtgacctctctacctgcctgataccttctctgaactgtgaactccttccaggcagcagctgtatttgtttcttctttgcagcctcctctgcgctctctcgtagacttcccagacagacctcgtggtgtcgtctccttcaggaagctgtcactgagtcccttctttggaagcaatatccttctgtttccacagcacttgactttggctctgatctcaagatcaccaactctgctaggtatgattgttctctgcacgtgtttcccatctcagattcaatggtcaatgctgcaaggatctatataactagtttccctcagagccctcctccccacagtctgattccagggtttggtatagacacagtccctaatagctgttcttgaggccatcatcccctctcatagcgactactacaatgacctgttaactatgctttctgaattcagccttgccccttccaattcatttactatcttgcagccagaacgattttctgaaatgtttctaacacaaatatgtcattagctccatgtattagcattctattgcagctgtaaaacatcatcacaaagttagaggctcaaaacaacattaatttattttatagttctctaggtcagaagtctgacatgggattctgggctaacatctaggtgtcagcagagatgtttctttctggaggttctaggggagagttgacttccttgcctttcccctgcttcttaaggctgtccatatggctcatggcccctttcctcaatcctgaaagccagccaaggcaaactgagtactttttttttttttttttttttgagacagagtcttgctctgtcacccaggctggagtgtagtggcgccatctcagctcactgcaacttccgactcctggattcaagcgattctcctgcctcaccctcctgagtagctgggattacaggcatgcatcaccatgcccggctaatgtttgtatttttcagtagagatggggtttcactgtgttggtcaggctggtctcaaactcctgatctcgtgatctgcctgtctcagcctcctaaaatgttgggattacaggcttgagccaccatgcccggccaattgagtccttttcacatcacacactcttacttcatcctatcctctgcctccctcttcctctttaaagatccttttggtttcactggggcctcctggttaatccagagactctcttcatctcaagatgagctgattggcaaccctattccacctgcactctgaatgttttcttttctatgtaagataactgataacttattcatgggttccagggattgagacatggacatcttgcattattctgccttcacattctaggtttttttcttttattttcagttttctttttccctaggaggactttgtcaatgcccctcttttcatttgggagttagatgttccttctttgtgtttgtgcagcccctgttctgctgctatgctagcattatcacactggactgttgttcccagtcaccctctgtctccctcattggaccatgagcactcgagagcaagaactacgtctgtcttattcactgctgtgcacccagccctaacgcagtgtctgatgcatgcactaggggctcaagaagtgcttattcaataaattgctgaatgtctcttagctgaatggcaatgtaggggagacaatccattcagctgtggtaccgcgatctccctcccatggggcctagtcactgccttattcatctctgcctcccttgccgtccttccttcacttccctagatatctagcacacagaataacaagtatcatttttaaagctaatatctattcatcgtttacgacgtgctagacattattctaagggctttgcatatacaatctcatttcacatgcacaacaaccatgcaaggtaagcactcttgttctacttttatagtgagggagcagagacataaaagaggaaaaatgcacagaacttataaggtgaggtttgaataatctaacttcatgttcttaaacactatgcaaaaatatgctggtgaatgtttaatttttccccaaatgaaatcctgaaaagtaaaggttgacttgttgcaaatgccgatgctggttgaatgtcttagatggatgccctttgttaaacgtatatcatgtgttaggttctctgcaggctttgtttccaaccctctcaacaaccttgtgagttaggtattattatctccctgccagaggtgggggaactggggctcagaggggtgagaatcactttcctggagtcatgtacaattgaatcagggccatctgcctccactctaccacctatctctccaaccatagtcacacttgtcttcttccctctttactgcccaccctcatttatacacaggtgtgcatgagcacacacacacacacacacacacacacacacacacaccacctacccccatacatacacagagtcagagtgaagcctgggttacacaaagcacatgtcttccctctctaaatgcaaaacaatttccaccagtggcaccaaactcacttaagcattccaggcatggctgttactaactcctgccctggtaattgcgatccctgaaattgaaagaaattgcaggctagaggaacattatcttctccttggccacttcgccctccatctcctttgcctgtgtgtattagcactgggatcccttgtcctgtcataacactgagaacaagctgagctgctgtcaccagggcctcttccagaactttcccctccactactcaaggaagacagtgaaaggccctcacaccttgacataaaatttagagatgtggctggagaaaagtcaacattactaggcatttttctgacaaagtattatcattatatctgttttccagatgctataaatgagattcagagaggaagattagccctgccccagaagctaaacacaaattgaaacctaaagatggcctccttaacagatctgcagggccagagtgaataattccctggttaaaagtggcagctgagctccttgatgagggggcacctcttagtccaaccctcctgctccagctccagccttaatcccaggactgcaggatgcagactgcctccctcaatccccgaggggtctagctgcttactttatcacagccaagggcagaagcccatatccctgtaactttcagtatgtttccagttcaattaggatcttcatattccagtattcagagtattttctaatcttaggaatcctctatctcacaccaacatttcactacacactcctcaagggcaaggcctggactccattcataccattggtatctcatgggtctagaataagagcagacacacagtaggtacacaaaaaacacttgccagatgagtccaagggtgaaggcgactgactctccctgaatcctagtgcatgttatcattccttatgcacccagtcctgccctggacagggagccaggatgtccaagttttacgaagctgtgccaataacttgctgtgtgatcttgagcaagtcatttcccatctctagggagtgtttaagtcctgaggtcatttatttgaataatgcaagtgtccccaaatggctccagtatgaagggctaagagaaagttctcaagatgagaagacctattctcatggacaccttatgtcttctctctcacctttttggaagtagtctttgcagtcacacacctggatttgcatcctggtccgccccccgtcccctgtgtagatctagttggacaaaacattgaacctttcctggacctttgtttcctcatcagaaaaatggaaataataatcatccttgcctcacatacttgctgtaaagatgaaaagagcccataaaatgaattgcttagcagaagacctgaaaatagcaggctctcaataaatggcagctattgctgctgtaaaatgcaccactctagcacattttaatttaacacactcaaaaagcttgttgtgattaggcataagaaggatgcaaatggacctgaaacccttttcttctcctcctgccctgacagcatgcacaatttgtccaagccacatgagagagctataatgagaatactggacatatggtcactaatttggggttattttctttacgtcatgggaatccttcccgcccgccactggtaaatttgattctttcctaactacagaacttacccacaacctctggtggagttggtaaagctaaaagcaatgctcccagcaccataagttgaatatctctcttcctatcacagcatgcactgaaattgccatggtgtgtctatttccctacttttggggggcaggaactaactgatatggtttggatgtttatcccctccaaatcccatgtggaaacataatccccagtgttggaggtggagcctgttggaggtgattggatcatgggggtggatccccatggatggtttaacaccatcccgttggtgacaagtgagttctctttcagttagttcacacaaaacctggttgtttaagcgagtgtggcacctccccttctctctcttgctctcactctcattatgtgatatgcccagctccccctaccttccaacatacttgtaagcttcctgaggcccttcccaaaagcagatgctggagccatgtttgtacagcctgcagaaccatgagctaattattcctcctttctttagaaattacccaacctcaggcatttccttatagcaatgcaaatagtctaacacactaactgtgttttctctctccttctgcagctcctaacaaagtactgggtgcatacttgatatccaattcgaaaatgtttgtagatgagccttcagtagactggacagcaaattaaagaaaaataacgtttaaaaactcttaaagcaaaagatagaaaataatcaaagccacattttaactgacgacacagcatcaattcatttgttacttcattccttgtagtagttagaaataaagaacttttttgaatgttaacatttaaaaccaagccataacatggactttggaatcagaacatatggcataaatacagctggttctggtgtgaatttgtggttggggtcgcatttctgaaagtttcttcttcccttttgtctttcccactctccctggggcaccttagaagtctttccatatagccacctctaatgagctttgcaaaatgagaaacctgctacagtagaagaaaatctaatagcaattgtttccttgttcactctctctctctctctttcttctctttccctctctcttttattagtcattagcaatggagaaagaaaacacccaaaggcagtagaaagacagtaatattcgcacgtgctttctgcaacactgcactaatgaggagccctgaccatcttgcatattccttcttattcaattccaacagtcctgtcataagttggagccacaagcagaacctagctagtgtggacattagccagtttgcttcataacaaaggtgaagtgtacatgctgttacaggacagctggaaattattgttaagtgctccttaacaccaagggatatcaagactttaaaagggcctagaaaaatacaaatccaattaatgaacagaatttttgttcttttcaaaatttgacatagaaatgtaattgaatccagtttgtaagaccctggatccagcttcccaccttcttagatactggttatgttgccatatgcaatcatacagtcatgctgagcctcaggtttgtctataataccctactccactcatagagagagggccttaaaccatacctcttactagatgtgctatcctaagcaggctgttaaatttcaggagcctcagttacttcactcataaaatgaggaccgtaatagtacctacttttataaattcaattatgaggattaaaagagactatgcatatagatagcctgtgtgcttcatggggtggtaaaaggaacaataactataaacagcctatgtatatatttgcctgtgtggtagttactgttactgtggttatttatttcctagtaagaagttcagagttaaagttctgcttccactcttgcaagtttggacaagttagcgtttcttactaagtttcagtctcctgatatgtaatggggacaaaataacagtaccagtgttgctgaattgttgtggaattaacaagataatgcatgcagcatggcacctgacacattatactgtgtgctccataaatgttaactattattattgttattattattattattagaaatgtgatttagggtttaaaaaataatatgcagcagaaaatcccagagaatccacaacaaaatactgctggaattaataagtgattatgacaagcttgtaggatacagatttacatacaaaagtctattgctttcccatatgctggcagtaatcaattataatttgaaattaaaaacaaaacatcatttacattagtaccaaaaaataaaatacttgggtataaatctaacaaaatacatagaagatctatataaggaagactacaaaactctgatgaaggaaataaaagatcaaaataaataaaaggagattccctgttcatcttcaatattgttaatatgtcagttctttccaacttgatctatagattcagtgcaatctctatcaaaatcctagtaagttattttgtaggcttggcaaactgattttaaagtttatttgaaaaggcaaaagacccagaatagtcaagacaatattgaagaagtaaaacaaagtcagaggactgacactacctgactttaagacttactataaagctagagtaatcaagacagcgtgatactggtgaaatgacagaaaaagagatccatggaacagaataggaagcacataaatagacccacgcaaatctagtcaactgatctttaacgcagaagcaaaggcagttcagtggagaaaaggtagtctttttgacaaatggtgctgaaacaaatagacatccatgtgccaagtaaaaagaagggatgaagaaaagaagaagaaaaacagacaaaaatctagatatagattctacacttttccaaaaataaaaataactcaaaattattgtaagtctaaatgtaaaaacctacaaaacttctaggagataatataggagaaaaattttagtaaccttggatttgattatgtgtttttagatacaacaccaaatatatgatccatgagaaaaaattgttgttggactttattaaaatgaaaactgctgctctgtgaaagatactgttaagagaatgaaaagacacgctatagactgggaatatttacaaaacatacatctgctaaaggatatccaaaatatacaaagaatacttaaaattcaacaagaaaacaaacagtaccattaaaaatgagcaaaagagctgaacagacacctcaccaaagaaaatatacagatggcaaatgagcatatgaatgtacacacatcatcccatgtcattctggaattgcaaattaaatgacaatgaaacaccactatataactattggaatagctaaaatccaaaacattaacaacaacaaatgctggcaaagatgtggagaaacagaaagagttaattgctggtgggaatgcaaaatggtacagccactttggagaatcgtttggcagtttcttaaaaagctaaacagtcttaccacgaaattctgcaattgcatgcattccttaatatttacccaaatgagtgtaaaacatgtccacacaaaactctgcacatgtttatgtgatcgtattcatacttgccaaaacttggaagcaacctagatgtcttttaataggtggttcaataaacaaacatccatataatgaaatatcattccacaattttaaaaaatgagctatctagccacaagaagacatggaggaatcttaaatccacattgctacaggaaaggagccagtctaaaagggcttcatactgcatggttccaactacataacactgtggaaaaggcaaagctatagagacagtgaaaagatcagtggttgccaggagttcagggagagaggcagagagaggaacaagtggagcacaggggatttttagggcagtgaaagtattctgtatattctgtatgatactatcatggtggttacatgatattatgcatttgttcaaacccatagaactatacaacaccaaaaggtaaattggggacgttagcaactaatattcaatcaatattggctcatcaatggaatacatttcacaacactaatgcatggtgaataataagaggagaaactgaaaggaaaagtggagataatatatgagagctctgtacttcctgcttaatttttctataaacataaaactgccttaaaaataaaatctattaacttaataatagcatgcatagtctaggtattttttgtagtcaattctattgttacaaagtgggagtggacaaactatacatctctaggcaatctgatgtccaccttttttttttattattatactttaagttctggggtatgtgtgcagaacgtgcaggtttgttacatacgtatacatgtgccataggggtttgctgcacccatcaacctcaacacgtcacctacattacatatttctcctaactctaaccctccccgagccccacaccttgcaacaggccctgctgtgtgatgcccgctgcccccacccccgcccctgctgcgtccatgtgttctcattgttcacctcccacttataagtgagaacacgcggtgtttggttttctgttcttgtgttaatttgccgagaataatggtttccagcttcatccgtgtccctgcaaaggacataactcatctttttttatggctgcatagtattccatggtgtatatgtgccacattttctttttccagtctatcattgatgggcatttgggttggttccaagtctttgctattgtgaatagtgccgccataaacatacgtgtgcatgtgtctttatagtagaatgatttataatcctttgggtatatacccagtaatgggattgctgggtcaaatggtatttctagttctagattgttgaggaatcgccacactgtcttccacaatggttgaactaatttacactcacaccaacagtgtaaaagcattcttatttctccacatcctctccagcatctgctgtttcctgtctttttaatgattgccattctaactggtgtgatgtccacctatttttgtaaataatgttatattggaatacagccacatccatttgtttttgcattgtttatggttccttgggtattacactggcagagttgagtagttgtgggagagcccacgtgtcctagagtttaaagtgttactattcggccttttacagaaaaagtttggcaatccctgttgtatagactctcaagctgaaaagtgtgtttaggagctgtttagttcaattacctaaaaaaaataaaataaaaatgctggaatcctcgcaaccacataattctgggaggaacaattttatagtctaacctctccaacaagtgtgaactttgacacaataatctcaagattattgtaggagaaatcaacttctcttcccttgctattcctgtaacccaccaggcccacaccttctgatctagaaatagcatgtcagagtagaacctggacacggactcatcacttacagccttcattctgaaccagttttgtcactcaaacccaccctgcttctgaacttcttggtactgactttctgctcatgcccctgccaccaactccggcttctaatttttagtttcaataccagatctgggtgccccagctatggcctaagctcctttggatccatttaaatgaaaaatacaatgataggctaaataatgaccttgaaagatattcaggttctaattcctggaaactgtgaatgacaccttatgttatgggctgaattataccccctcccctgcaaaaagaaaatcctcatatgaaattttcagagtcactccctccctgagaatcgcagaatgtgtctgtattcagacatagggcccttaaagaggtaactgagttaaaatgaggtcattaagatgggtcctaatccaatctgactggtgtccttttaagaagaggaaaactggacacattgacagcaggaatgtgcacagacagaggaaagaccaggtgatcacacagagaaaaggcagccatctgcaagccaaggagtgaggcctcggaagaaaccagccccgctaatgtcttgatcttggacttttagcctccaaaactatgaaaaataaatttcttttgcttaacccatccagttggtggcattttgttgtgacagccctagcaagctaatgtatcttatgtggcaaaagggactttgcagaggaacactctactagtctaactttccatctgcattaaatcaaaggtttaaaaatggggagagtatctggattatctgggttggccctaagcgccatcatgtatatccctgtaagtgggaaacagaggaatatctgagtacggaagaggcagaaggtgatgtaaacatggaaggagagactggaatgatgtggccacaagccaaggaatgctgacagctgagtgagacaagtaatggcttttctctgggagcctccagaagaaagccctcctaacaccttgatggtgaccctacaagactcaatttggttgttgcctccagaactgtgagtgaatacatgtgtgttcttttaatcactaagtctgtggtaatttgttacagtagccatgtaaaactaatggatgtgctttttcagataaatattgtttggggcttagtttgatttccaggccctcctcgtccacagccacccaacttttaagcaggcatcagacagccacttaatcactgttctgtccaaatgagagtagcatgcttatttaagctacatttctaggaactccgcagagaacaagctctaggggctcaaacttagtcttaacagatgccagagctcatggtctcaggcctattatagaacctatctaaacctcaatttcctaatcagtaaatgtggatcaaattatcaaccttctaaggttgttgtgacaattttaaatgatataagtaacacaaagaacacattttctggaatacagttattaacattctcaataagtaatattaatgatttctgtcattaattgtttgtggctctccagtaattccaagtctaacagatttccatttcccaaagccacagagagaatttgcaaacccatggcttggggcttagctctggcacctattcagtgaatttgtaccaataaatgtttattctaaaccctacccccaactcccttccactagtcagccttcttctatcagcagctggaaagttagctcaattcggcctccatccctgttacttccctctctcattctttgttatctccagttatctataagatgctccgaataaaacacacacacacacacacacacacacacatacacacacacttggtcatcggtgacttcaattctgctattttgcactaaaggaaactgagtggcttaaattcagaaaggcaaagtgatgtacccaaggtcacagagccaataagtgacaactttgtgaggtttccagggtgctattatgccacactgtgtctcacttgctgggcctgtctctccaaatcctccaccctgaaatagagtgcttccgcctacagctcctgctgaaatgggaaaagtgtttcctgtccacaggccagtcccctctccttccctttttttgaggactcctttcctcagggcagctcctagtgaggaaacagataagaggactccaagcaggtggtgcgaagttgtgagtcgccatgcccttgtgttggagaatgtggcaacacacctaatagtcctccctccctgcaggaaaccaggaaaccagcacttacccggagtgccttcctgctctgtcagcaatccagaccatatggttaattagctaaaatttgcgactgcatctgtgaagctatttttctttttggcatgcgtgaacttaattaccgaagacatgagaagttcctggcccactgggatcacggtgggcatgggtgtcacagaacatgcccatggctcagggtgtgagatatgtgggtggttgagagtttgagaaatgaaggatagagagagttgcttgaccagaggaggatggggtctttcttctggtgttcatgcagacatattagtaaagaatttcatggtgagacacaatgtcacaaggacccccatctgtgtatgtggacaagcatcctcaaaaaatggccaacccccttgcatggtagaatgtagggctcatcgtcttattaccccactgccctgcaaattctatcattagttgctccacagaatatttatcttcccagaacatatgactgtctcccccgcacataggacagggcctgtaacatagaaggtgtccagtaaagatggctgattggcccagtggatgagaccaatcatcttctgagccttcagtttctcatcggcagaaggaagatcataaaaaagttatatgcttaacaaattcttaatttgttaagaattaaatgagatatagtacatagaacacctatcacaggccctgatataatgacaggtgtttgataagaatttgttgaatgaatgaatgaatgaatgagcagccaattcaaacagaaactgaatgccattactagaagaagcctgagagatcaaaatctagtccagtccctccactgtgcctcagtttcctcccctgtaaaatgaggccaataaaatcacttctttattggattgtttgggaatcaaaatagcatgtagaacttttagaagagtgcctggaatgtagtaagaagtcaattaatattgctgctattgttgttgtgaataatagaaaatgggaaaacttattgctagcaaagaaaaaggcctcgcacaaagaatagcagtttgtggtgtgtcctgcattgtaacttggagctccttctttcagttcatactgctacttcctgagcagtatgggcttgccatgccaggagagtgccagggctcacaggacagacatgtgccagctttcaggggtcactggtatgacagaggagacaaattcccctttccctctttggaggacacccaggctaagaagtaaggtccagggttattttggacattattgacagaagaaacttatctatcaggagctctctgatgctcccaaacatagttttgcagattgtgccacagctgagagggcaaatggagactgaaattcatccctgttctgcaagccaagcttagtgcgtatgcagggatgtgtctccttttttcaattcacacataggcactgtattggcagctgtggcctcggagctttctctgggatcaatggacagcttgagggcaggagaacttgaagcccaagaacactggggcaggtgtttcatgggaccagggccattgtctctcatactcatctctgtattcccagggctgcctagtatagtgcttggcttagtggacacaaacacatgttggataaataagccactgtgttccttttattttattttttcttttaaagacaaagtcttgctctgtcacccaggctggagcacagtggtgctatcatggctcactgtaacctcaaacttctgggcccaagcattcctcctgcttgggactacagaagcgtaccgccatgccctgctaattttttaattcctttgtagagacaaggtctccacatgttgcccaggctggtctctaactccctgggctctagctgtcatccccacttcagcctctcagagggctaagattctaggcctgagccaccatggttggcccatggcattcttaatatctatcatagactctaccacttggtatgggcccagtttgtgctggataaatggatgactgaagcattcagaagaaaagtatgtgtgagaaatgatttcctagacctttagccctatagagtaaaagcaaataatttattgaggggcactgagctgtaaacattttctaccttaagtctcaaaacatacataaccgattgttcgcaatttacctatgagggctctgagatttgcctgtggtcatacagctcctaaggagcaataacaatatcagaacctgtgttttgctgctaccagtgcctgttttcacaaccatgctcttctcttctgggtcactgacttggctagtgagaaatataacattccctctgtctgctatactatttctttctgcttgtatactgatgacgcttttacttcattcatgcctctgcttaattgtcacctcctccaagaagcctgacgtgatcactgtgtataaagcaaaactttccaattccttatccttctttatttttctttatatcacttataaccactggaaatacatgtttattttctctctgctgctgccccatccccatctcttcccagaatgttatttccatgagggcaaggaccttaatctctcttgctaactgctattttaccaacatccagaatagtacctgacacataaacctgctcagcacgtatttatgaaatgactgagaggatgactgaaaaaccctgggtcagatagttaaatatccgtttaatgtcagatatgatctttctcttgcaggaccctggtttctttatcagtcagaaaagatacgaagtgccagacctgaggcttccctgtaaatacgggaagggctaacaggacgggtttaggagcttaccaaaaaaataagatatcattattatcattgcaaagcacatgtgcacatactccatggacacagatctttcatcctctccaggtagaacatcccaggtgactgccaaaacttccctgggctgggatgcacaggctagcctcaaagtgccagcttttgccacacccaggagaaaggcctccactaagccaaatcagtgtctcagtgttaagactattttttgaacagagaagtatggggcagcatttgtggcaccaacacttggtggccacataatattgggtgagtcacttgcacaaaaccaaagtaatgataacacccatctttgagggcacttgctagaatcaaatgaactgatcattttacaaacactttctgacatacaaagcttaacactgatgtaagaccctaaccttagacgtgaaagccaggctgagcaattcagacctgactgtgacttgggaacaatgggaggattccgagcgaggaacagacacattaaggcatatctttgggaagcaaacctggtagtgtgtgcaggctgggcctctgctgttggttcctttttttccttctagattgtgcctggggaagggggaggggagagaggtagaatctgcagtgtgggaaatcccactttgactctaccacttgcagaagggagtgggggtggcagggaacagacttgggtgacaggcaccacttgtgccaccctgattaactgggaaaatgcaaatctgcacttccttccccgccgcagctaacaagataatgaatattttcatcagctgcagagaatacaaacatctgtaggaacaccaaacctactctcaagggttgggggaggaggggaggacgcggaggtggggaaacgcagcttctctgcagatttagggaagaggaaatgtgctgagatgctggaaggatggctgggagctggaaatgggcagctctggctggcgcctcccatgcatggtacaacggggaatagctaactgtcctccacccctcatatctgctgttcattcgtggttgtgcatgttgtcactttgtccagcaaccttcaatttattcacctgcacctgcatcgatccctctgcccttccactcatcaagtcactaaacatttgctgattgctattgtgtcccaggcatgaacctaggctctcagagaacacagataaatgagacatcccttgtcctgttgtcttaaagtagctcattcattcacttaatgattaaattcttattaatgaagtacctgctgtgtggtaggtactcacaatcctgttgaaatagacatgggaactggcctactcttgaaggtgctctctgcaagagaagagcgcagagtaggaaggatcactcagcctttcacggaaagaggtgttcaaagaagactcctggaggagttggcggactcctgatgtcaatcaagaatgaatcagagtattttaggcagagaaactagaagagcattccaggtagagggaacagcatgtacaaagtcaagtaggcatgaggaatcccagggaactcagggaactacaagcagctctgtagaaatgggtgatagcaggtaagacaaggggtgggaacagtgacgggagacacttgagagatgggcttgagtccaggtatctggaactgtgtccaccaagataaagaggttagactttatcctgggcacaatgaggaggccctgatgagctctgagcaggggagtgatctaatgagacctgcatgttagacgatcattctggctgctatatggagaatgaattggagtgaattcaggatgaagaagagcaagggagctgttgaggattcctgtcccttatgcaatattcagaaagaattggagagaacactctgtgggtgctggcgaagattcttagatgtggacatgcagctttgccatttaatcaggtctggtctgtggctttgcatagctccctgagagtcagggcctactaataattcctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgggactcaactgtgaggtgtatttgcccatcaaatgaaattattatgaccagttggatataccttactttactataaagaaagacccaggctggagatacagatttcaaaaacaacatacatgggatgctctgaaagtctgtagcccagagaaagtgtgtggggagagaagacaaaaatactaagcctaaagccccaagaaggctgggaagtatctaaagaggcaaaagaaaaccagaagtgtactatacagagaagtcagggaatgagttttcaaatgagtaaacaatggtgctaaataaaagagttgggatgaactgaaaactgaatcacatctattggatataaccataaattggtgcacttttggccttgggagaagcagtgactgtgagtgatgagtgtagaaggcagactgtggtgggcgggagagtaagtgggaagtgaggaagtggagaccatttgcatagatttctctttctagaaggctggctgtgaatggaagacataaggtggtagctaaaggcaaatgaggaggggatgagtttggagagacaaacacttatgggctgaaggaaaagaacaggagagaggaagatacttaagtcaaaagaagaagttattaatgacattgtattccttaaaagattggagaggatggggtaagtattaggcaggagaagaaacacctgttcccctaaggcaggaagagatgcaagaatatatgtgtatgtggcacaaaagaagaaagtctgaaagttatgctctttcttgcctgatgatctcacttgtattttgtctttaaaatagtggatgaagctgggcacagtggctcatgcctataatcccaacacgttgcaaggtcgaggcaggagaatcacttcaggtcaggagttcaagaccatgctgggcaacatagcaagaccccatctgtacaaaattaaatatatatatatgggcatggtggtggggtgcctttaatttcagctacttgggaggctgaagaaggagtttgagtttggtgagtaataattgtgccactgcactccaacctgggaaacacagcaagaccttgtctaaattaattaattaataaatagtgaatgacataagaatactgaggttaaattgggggcataaacaagggctctgagagttaaaaaaaaaaaaaaaactaaaaagctaccgcaaggatagagaaaaggaggagatcaacaagagaacttccaactagtgtcaaagacccagccgatattggagaacatagatgggggttggtgcccatttgcactaggtgtggattatgccaactgcagatggctattcccaaggttgtaggaaagatagttgattttttttattcagatctaggggtctataccagaccagtcctttcctcacctacatcttctacaggacaatgattatagcaacagcagctaccagttgctgagtgcgggttatgtgccaggtgccttatatacaatatttttaattcttagaatagtgctgaaaaactatttccccttcatcctgagaaacccaggtcccagaaaggtgacatagttgatccaaggtttcatgagcctgtctgactccagatccctggctctttctctataccttgtcacaacctttgaggcttgacatcagctgtcatttcctttctgagcatttgcttctccaagataaacagttccaggctttgaacaccttcttatggaagcttctttccagtactctcctgttttccttcccaaattgttagtttcctgttcttgaacacacatgtatttacatatgtttttttcaaggtgatgagtaccctacggaaaagccaagactcctcaataaaaagttcttgagaaggactctcttgagggttttccccaagggcaccttcacatgttttaatctagtctcctacctaaaccaatgtgctaattaagatgctctctgaggagccaagaaagtagaacctgccattatatggagcttcaccacctctctggctccccttgcaaaaattgatcctgtgctccagaaagaccaaaccatttactgtcttatgtattttctgtcatgttttctgctttattcatctgctgatctctctgcctaaaatatccattcctttgtccttgcctaacaaccatttacccttcaagattcaactcagacatcatctcttagaaaccttctcaggtagtctggctacatcaggtactccttgcacttcatgcttcctctatcatcacacaggacttgtagggcacagtgattaagagaggaagctaatggactcaccagtcagactagacaagacctgctacagggcacttaatgattgtgtcactttacccctccatgttcccatttttcagctgtcagtggaggatagtgaatgtctatctcataggtttgttgtgaagaagaaataaggtgatccacataaagcacatggcacataatcaatggtagttattcttataacatgtatcaaatagtactacatttatgcttatctttctcccaccatcccataagtaccaagagggtaggaacagcatccaatttatggttctactcccagcacctcactcagaatctggcacatagtaggagctcatgaatgaatgaatgaatgaatgaatctaattcatctcagtgtgtactgtctttgggatcacattatctgaaattacctacttaatttccattatatttagagtgaagatgaagggtaagatatatctttttcaattaaagggcaagaggcctctccaagaatagcctgatgacatggagatttatggatcaagtgccaggctctcagcagtccatggacagttggccatgcccaactggaatatggtctctttcatttagaaattgtcaaggccaagaggccaggcagccaggagtgtaggcaggcaagagaacatctagggtacatggagggatgaggactctacatcagtgccaacattccactactactcatgcaaacaacctttcttgctgtttatgactggtggtcaatctgatagctccaggatccatcctgattgcctggcagccatgccattatatttacaaaatatattaaatattctctcttttaaacatcagaatcctaggttcccagcaggactgaaaaagttgataaggaacccaattagagaactgcaaatgcaaagactagatttcaggttgtgatatggtttggctgtgtccccacccaaatctcatcttgaattttagctcccataatccccacatgtcacgggagggacgtggtgggaggtaattgaattatgggggtgggtgtttcccatgctgttcttgtgatagtgagtaagtctcacgagatctgatggttttataatgggcagttcccctgcacacgctctcttgcctgccaccatgtaagacgtgcctttgcttctcctttgccttccaccatgattgtgaggcctccccagccatgtggaattgtgagttcattaaacctctttttctgtataaattacccagcctcaagtatgtatttaatagcagcatgagaacagagtaatactggtggtcagaagctaagatcaaggaggtggacttcaggtcaggtaaatgccaaccatgtagttgagtcagtgacttagaaatctgagcactgccatgtgaactattccttaaaagactctgtcagccagaggttcactatgggttacaatgatcactgagccccattcccaggacttccctcctcctcaactcccatctccctagctctcttctccttacaccagagccatgtaatttgggccagcagtctcatcttggctgcagtcatcaggacctgattccagtcaaaggaaatatatgaacctccgggtcagagctcagggggcttagctttaggctagcacttgattctcatgtctgttgaaaatacaccaaatggcatagtcattatttctttaggggtgtgtctttcctgctagcctgaggctttcctagaagcagtagaataaaagatggaagagaaaaagaaataaaggaatggaaagcgaagaaactgagctggctcctgcttttcctctctttctagaaaccagttttggacactggacctccatcctatttttttttttttttgaatacctgtcttgatagtctgcccagtgagccatgttcttttatccttgatatttttcttttaggacatagaactctaactctaaatttttgccccttttctggggccattagcctttagcacatgcttgattctcactgcaaagtcctggatcccaactctgagctaacatttacctgccctgcccaagggggtctgtatgaaccttcccaacctgatatcataaagctttttcctctctgaaagtctcttttcataaagtttatattcctgccaaggtcttgaccgagaggtctgtggattctaagaaggaaatgctgtagtcaggtggggaggtcatgagaaagatggggtcacagaaatggtggtagcttaataacaggaaaggcagatggaaccatgcctccttcataagggagaacctcacacaaagatgggctttaaaaagttgcaataaacacagaactcagaattaaggtgagaaagagagaaaaagaaaacatgctctgaatataccacatactgagcaacacgaaattattaatacacatattatctcatttcatgttcccatcttcccttgcagtaagagccattatcctcattttcacagatgaggaaactctggctcagagaggttaagaatcttgttcaatatcatcaagcaagtgagggatagaaaacccaggattgaatctgctttgtctgattgtaaagacttttttttccctcctacagatacagatatttagcctagattggaccacccatgcacttctaaggcatacattgttcccaaattagccctacatccccatgatacctatctttcatagtttaagagagaggttactgtcttctcttattgtctggctctgtccatcaggaagttgtagaatcataggatataaaaactgtaagtacatgagtggtctgttggaacagtggtttgtacatttatttgtagcagaattcatgtttggaattcctatacatgaaactgacattgcatgcagcagactcctcagtattcatctgtatctctctggaagggactcttcaggctcttctaaagaccactgcccctccaagaaacacagtctgatgtactctcaccctcattttctcatttgtacatgaggactctggagatcagggtcaagaagggcttgcccaaggttactcaatggaagaacaaggacaagaatctgtatctcgtgctttctattctacacagtggccaagaaatattcatcagggtaaaggaaaaggtatcctggatccatgaaagtaagctatttgggagtgggttgaagatagaagctttcttctggtggaaaataataataatagcacccaacatttattatataccttctgtggtgctaggtacaatgctaggagctttttttgcattattccatttaatcctcttatcagattaggatcccattatgcagataaggaagctaagccttaattcttcagcactaggtgacccagttggtaaatagctttggtggatttgatccctggccatcttgctcgagagcctggctcttagtctgctctactgtcttcctaggaacaggaataataatccagtgaaggctagaagcttgttcatatttaccaacatatccttccctgtcctcctgctaatctcccagcaaatgctctgcaccatcagacatctcattttcctcaccatgactgctaatatgcagggccttcggtataaatgtacaccctctacccagcctccagcaaactcacatgcacccatctacacacatgggcacatgctcatgcataatgcatgggaccaccatcttaaatcctgctaaattgagattcagctagctgtttggtctggagacacctcagtgcctgcgtcattagctgagctctgaaagccatcattactgcagccactgtggctgagtcactgagaccatgagcaggtaatagaatttcagggacacataataaaagggaatggaatgggattcaggtcggaaaagactatctgttatccagtcctgaagggtggatatgtaaacaaggagctccaggcccccaggatggcgattccactgagtccctcagcagaggataataaaaggcccaattacaacctccacactctgagatttcaaaggaaaggaagaaaaaaaatcaatgaaattaatttaatgtggacccattctttatgtttgctttgctagagtagttgtatgagatacctctatagaccagcccatcttttctcacacagtgactttatccacaagaaaggaaggaaggaagaaaggagagagggagagagggagggaggagaggagaagagaggagaggagagagggaggcagatggggaagaagggagggaagaagggaggaaaagaggaaggaaggaaggaaaagaaagggggcaggggaggggaggggaggggatggaagggagggaagggaggaggaagtaagggagggagggagggagggaaagaaggaaggaaggaaggaaggaaggaaggaaaaaggacaggaagggaagggaaggagggtgagagggagggagggagggagaaaggagggaaagaaggaaggaaagaaggaaggaaggaaggaaggggaagggaggaaggaaggagggagggaggaggaaagggggaaggagggaaggaggagggaaggaggagggaaggaagaaaggaaggaagaaaggaaggaaggcaggcaggcaggcaggcaggcaggcaagccaagccttcagacatatttgtttctgacatctcaaaggaggacaaatcagggaatccaaggttggaagagacattcaaatctcatttttcatggcataaaggaaaaggcagcatctctacgtatgattgtgcagcttgtgccctgcataagggtgccccactgaagggagactgggtattgaggtccagtccatggtctaaatggacaagcactaatccttgcatggcttgcatctatacatgtataataagcaggaaggatccaaaggtagagctagctcttctcactaaacaggcaatcagagatctgcattctgtggggtttgtattctatgtgatcttttatgtgtctgctttctagatatattccctcttttgtaaaggaagggttttaggtaaggtacagggtgaggggactatcattaatagagtatggaattcccaccaagcatagtgctgagtataaagcatttgtcttaatcttttcaataatccctttttaggttaattagtcccattttacagatgtaaaaaagcaaggctcagagagttgtgatgggttacctgcctgcaggtcacaaaacacctgagcagagaagccagaattgcaatccaagtgtccgcgcttgaaacctatactcttccctgactatatgcctcctctctaaggctgtttccgctccttgttttctgtgattctatatgtaaaatggccttggttattgaggttttgggggtttgggataagggtggagggcagaggaatatgttgctaccaagtcaagcaacagagaacaacctgacaagagttaatgggtttgtgtaggggaggcaggagcttggagagtgctggcaatgagactgaccaaaaacagaactggtccttctaggaagctaatgagtaagtaatcctgaaaatcactgtccagtaagcctggtgtcaatattgagtaaaataattggacgaatgtgcccagagataatctgtaagcattggaaaaataatggaatagtgagcgataagggacaccagaggttcatgcagaacaaatcattctagacaacttgatagcttttcctgacaaaattacaaaattagtggatgaaggagacatcgtaaaggttctggattttgagctctaacaaaaaattgaatagcatttcttgggatgcctatcttgccaagttaattcaaactgcccctgattcaagctgtgctgtgtgaatttgtgttgttaccaaatctggttggacaatggagccaataggtgctgatgcatggtactgctccaagggtaagggccagagactctcacccctctctctggtctggaaaagaatgtgacagaagggctactgagacccagacaagaaatgcagacatccatacagcagggaaagaccctggggcaccagggggaaggtacattttttagataatttgataatcatatccttcctatggggcaggtgtcatcatctcaccctctgctccattattcacggtcctcgtaattttgcttataaggaactgaaggtcagagtgggagtggcttatcacacagataatgagttgcggcacctaggttgtaacccaggtgtgtctgattccaagaattggtatactctcttctctgaccagtggttctcaagcatcagtttacatcaaaatcacagagagtagacgtggcatgtgaggcggggtgggagacagttgttaaatcactgattactgggacccacccctagggtttctgactccgagggtctggagtggtgactgagaatttgcatttcaccaaactcccaggtgatgctgatgttccaatctaagaccacacctccagaaacactctattccagttccgctcagatattaatgtgcaaataactcacctgaaaatctttttaaaatgcagattctaatttagtgaagttcctgggaaatgaagcaaattgcattactttctcttttttttgttttttgttttgttttgtttttgacatggagtctgttgtcaggctggagtacagtggtgcagtctcggctcactgcaacctccacctcccgggttcaagcaattctcccgcctcagcctcccgagcagctgggactataggtgtgtgccaccacacccagctaatttttatttttatttttagtagagacggggtttcaccatattggccaggctggtcttgaacttctgacctcgtgatctacccaccttggcctcccaaagtgctgggagtaccatgcctggcctgtaaattgcatttctaataagctcccaagtgacgtctatgctgtgggatgttaccacacccaagaagcaaacacttatgccatgatgttgggaaatgagaaatctagaaagatagcactacagttcaagaactgactctggaatccaaaagtagagaaaacagacattataccaaaaaaaatgagctgcaggaaggacataatttggaagatctgagttcaaaatttggtcatgtctttactagctttacaattaggggatttttatttattttattactattatttttacttctttaggtatcagtgtgcttattatttgaggatcaattactaaaaaaaattaaaaagaccatagggaaaatacttgggggcttctcaaaatgattgctgaagataccctccatggtattgctcaacatttcttgtgaggaaagccatgaataaaactgttctcaggatgcagtgctaattagtctctccttcccctgatgactagctatagctccttccacttgcacaaggaacccagtgcacccatccttgtcaaaattttactcgactcagcaccatttatagctgctttattaactcagaattctagaataaaacttgttctaaaaataaagtatacccctctgcattaaatacctcactatatatatgcaatttatcgccacctgtctgaagtcctttaggagaacagagggggcccgaatctaaatgattgattaagtgaatgccaatggaaggagtgtaggctcctcttgagacatctgtgaaactcaagagggagaaatcaaagaggaactatcgcatactgttaggtacagtcagaatgtaatggctaattactattatgattgtgattattatacagtaaaaagcaattacactttaaacttgatgtttaagaaacctgtaacaaatacaactctaccccatgtaattttccaaactcaatcaattcctaccactctccccatatctctgtgtgccctcctgttatggtctgtccccaaaactcatgtgttgcaaatttaatccccattgcaacagtgttgcagggtggggtcttttggtaggtgtttgggtcataaaggctccactctcattaataaattcaagcctttataagagagcttaacagagggggtttggtcccttttttccccttctgtcccttttgccaggtgaggacacagcatccctttcttccagagaacacagcaacaaggcaccatctcagaaaagagaccaagcccctcaccagacactgaacctacctgtgcttttattttggacttcccagcctccaggagcatgaaaaaataaatatctattctttataaattacccagtctcagatattttttttttttatagcaacacagacacctccctacatcacctgtttcctggagcattccctgacctttcacctttgagttcccccgacagggcctatctaccacaaagaaaattctaaacattgacttatttcttaaggttcctcaaactccaggaaagtcttctctagtattgctaatttcccttctttttctgttcattttctcagagtaacataaatttccccaaagccatgtgttgtgtatggctctccatggccaatatcaggtcaaggctccttccatgtccacctgggtcaataattaatttattcattcatctccattttcattcattttttaaattcccccctggtctcagcctttccttcaactatttcaccactcattaatcacttcactaatccattcatagaatcaatcatttacacacttattatctacatattaattatatattcatgtttatgtatcaatctgctgagtagtttatttgattttcattcacacatcaattctctcatcacacattcattcactcacccactcattcattcattgaacaactacaacagtcactgggtgctcactctgtcagaatctaacttgagtactgattctagaagatataatctctgctcttgagaaattcacaaaccagccaagaggacaaagaagcaaacggtagaataccaaattctgtgtggccagggtggagcagaagagaacaggaggttgaaaagaaaaataagtaataataactgcacacctactgtgtgctcactgcttcatatgcattatctgatttaaatgcacctttctctttaataggtaatgaaaccaaatttgctcactgaatggacttagctgaaatctaagtctaggcgttctcattctgctccccatgctcttaaccactctgctgtattcaccgtaatataatcagcgaccttggtttaggattagcatttctggggaacagtgtgggagcaatcaaatttgaaaggtgtgagaagcaattggaaagtgaggaagtgaagacagtaagtttctatcacgcagtttgtccttccaggggagaagagagaaggctgtaactgaagggggcttaggattgagcaccagacagcagaagaacctcatgaccctgggcaagcgtatctatcatagtagctttcctcattcttttccgttagttctcttcatttccatttccccctacacaaccaagagctattttatttacttttgtatatactaggacttagaatagggcctgtcatagcatagttgataaattaatatacatgaatgagtgaatgaatgaatgaatgtcaaattctttttttttttttgagatggtgttttgctcttgttacccaggctggagtgcaatggcgcgatcttggctcactgcaacttccgcctcctgggttcaagtgattctcctgcctcagcctcccaagtagctgggattacaggcatgtgccaccccgcctggctaatttttgtatttttagtagagacggggtttctccatgttggtcaggctggtctcgaactcctgacctcaggtgatccgcccacctcggcctcccaaagtgttgggattacatgagccaccctgcctggccatgtcaaattctttaaaatggattcacacattgcctagagttctattttgcagaaaggagggagaagtaggtcagctgactggagctttctacaaaacagcccatggaacaggccttgtcttggaaagatggtgatgcagacagagtgactatgataaccaaaaaataaactaaatcaacattgacaaggaaaatgtaaattcagaaacagggaaaaactgaattcaagcgctagtggtggacaggaccaaagttgaggacacaagtaggcatataggatgttcttaaagcagacaggaaattggccctagaaaactcagacctggggggcaaatgtcacatgcctatatcatttggatgtttgcacaatttcctggcaatttgtgtcggtccacaagcccagcagagaaaagtcttacgggtgtggagaaaatgaaggttttagcttcagtggggtgggtttaattagaactgttattagtctgttgtgcaaaaagctcattagaaactcactggggctctcaaaagtgttggacatttttttataattacatttcttctgattcctccatgggtttcttgatgcagtctgagcattggatctattaaaggtgtgtagggaagaatgacttccggttaacttgtcatttcagtccagggccagatacctgcagttcttgccccacatattgttgaaaagaagaaaggaatctgaaagctggtgaactgtagcaggttctttgacatgtgttattttatatcacaacaagcagaggaactggatgttcagatacctcgagcagctttcacaaatttacacagctagttagtggcagcatcagcattcaaaccccagttggtctaactccaaaacccatactctttccagagccccatgctgcctccgacagtgagacttcttttgtaagagaaaagatttctcacttcagtttggcaactacagtttggggaagggagagaaagtgtgggcagggtagcaaagggagagaggaaaaaatcataccatgccagtttcagactcaaagatcactctctagctgtcagtggagcccacaatcactgtggagttttattaaaaagcaagagttgtagaagaatgaagcgacagatttaaaattaacttgccaaactccccatcaatattatgacagtccccaagtaccagttcagcgacccagtgcaccaacttgacaatattaacataactttgttggaacaaaagcttctcgaactctgtcttttcaagtgaagctaattttgaggagacagccattcttctttctgccttttttggcacctctgtgacaggtccccctggcccaacctaagagtgcatgttttataaacttctattatcctttcacctccctggggactgccacccactctggatgcttaagtcaagtagagcagtacttcttccacttagggacgtactgaatgaatgaaggctgggaaagagatctgcatacttgccactttctgaacactgacttgggttccctttggtctttatatttggaatgaagatccgtgatggctaacccaaccaaaattcacatttagggcaatgtgctctctgtaccagcttttataagctaactgcagtctgattccctctttttcttcacctaacaatctcttacttacccttcacatctcagcttagacattaatttcatctacctggagtcctacaccccatgtgggcttgccctggtagcactctgactttcatacctaacactgcacgggtcagtttatcgaatttcactcactaagtatctttcttttgttagtgtatgagttcagtaggtagagtgactacataatttatcatgtgatccaggggacttttgtctaggatatacgctaaactggagaggactttggacaacagtcaaactagactgtcctagtaaaactaggatatatgagcaccctccacagatgggcatatatcgcaactgtcaggctttctgcgtctctatcacctcgaacagtggttaaaattttagtcagtgtagcatattttttgaatgaatgaatgtataaaacagttccttttttttttaaacaagtctcacaggcaaactcataaaatctttccttccttccttccttccttccttccttccttcctccctccctccctccctctctccctctatctctctttccctccctccctccctctctctctccttgtcattcttccctcctttcaaccttctatcttgttaacgacctaccacgcaccaagccctgttcactctaattactgggcatacaaataaacatggctctgtcttgggagtgagaaggagaaacaattagcatgtagtgagcatctactatgcatctgttgctttaaacattgtatattattaatatatatccaactattcagtgaggtagttaatatgttcacctagacaatgaagcatagagacaggtcaggtgacttggccaaggtcacacagctaatagcagcagaggttgaattcaatttcaggtctgccagagtacaaagctgtggtctcatctctaaactaagctactgcctaaactgtgtagaaggaaggcgaaatatagggcagtacagggtgtaaagagctatgggctgaggaggttcctaatacatgagcacagaagcttctctaacccacaaaatcttatgctctttatcgatggacataagaaaaatccatctctaacttacagctaccatttgttgagaacttagttgtatagatactttgctaggtcttggaaatttataataatgaagagtcaagagtcaagttaagcaggggaggtaaatatcaaataataatacaaatattaattttatttttcacaggtatttcagagaaaaaaatagtatgaggaccatatagtatgagacacagtattttttaatcactattttcacagataagaaaaatgaagcttgaatggataaatggatcaagactgcactctacagagctaggatttgaacccacatctacttagctccgaagtctgtattgtgtttacttccccacttttctcctgaacaattcaatcataacacccctaatgaaacagagcaaatccttcaccactacttttcatgctctttaaacctcaaagtttttacatgcagaacagatataacactggctcttctctgtaagcttgttgtggcaattaaagaaaagacagcacttgaagcaccttgcagagtgcctggtccacagacatgttcagtaaatagcaaatattgtcatcattaatattattagacagtattgaattattgactaaggtcatgtggtgctccatcacacacgcaatgtcctgtgttgttagttaactttaacatgggcatgttttcatggcattctcccattcccctattgtccccacctttgagtccctcagcctagcactgtgatatgaatggagcagaatgtgtgaccaaccaagtgttaaaagaggagagaggctgtgttggggggctcatgcctgtaatcccagcactttgggaagttgaggtgggtgaatcacctgaagttgggagttcgagaccagcctgaccaacatggagaaaccctgtctctactgaaaatacaaaagtagacaggcgtggtgccgcatgcctgtgatcccagttactcgggaggctgaagcaggagaatcacttgaaccagggaggtggaggttgcggtgagctgagattgcaccattgcactccagcctgggcaacaagagtgaaactccgcctcaaaaaaaaaaaaaaaaaaaaataagaggagcaagaaatggatatttgaatatggatttggagccagactgtctggattccaatcctgtctccatcctttaccagccaaatgacaatgagaaaattattcagtctcttaacaattcagtgtcatcatctgttaaaaaataagggaggggaaaaggttgacagctcctctaggtgtctgtagaactgaatgcgtttggacagtgaagctgctgcctgggtctcttcttgtgtcactgggagctcatcctcagtctcctttgctggtggctcttcacctctccgatgttaaactgcaggactcagggctcaggctcctctcttctctatctactccctagtgagtttgtgtcctctcatttcttttctgtcatctacatgctaaataatctgaaatgtacatttcaagtcatgtttctcttctgaactggtatatcctactggcttcctgacatcaccataagaatatatattagacatggccagatgatggctattgacgccggatgatgagtgcctggggttccatcacactatggtctacttgtataaatgattgcaatgtttcacaatcaagttcatcttttaacattatcaaaaacaaatttctctttctattcccctcccttgtgcctgctcctcctgtgggctttcctgtctccatcaatggcacatccgtctgtccaactgctcaggcaaaattcagggcactaaccttgcctccctcctttctctccctcatcagtaaatctagttgtcccaccttcagaatacatacagaatctgcccacctctctccatgctgacttgtctgaacatgctccaatccacagtcgtctgacatctggaccacagaagtagcctgggaactgctttccctgatttcaccctgcccactaacgtctattcttcacaccccagtcagattatagaccttttctgctcaaataatgcactagcttggtttccttctcactcagagtaaaattcaagctactgcatttaggagtcccacaggaccctatacaaaatggcccatacttccccagttggtacccattgcctctttatttgtaaccttttttcctactacttgccccgcctccttcccctctgttctatccaccgaggctccttttggtccacagaaaatgccaagggtctttgaactcggtgtgccttctacctggaagctgttccccagatatgtgcatagttcactgccttgtttcagatctttatacaaacgtcaccttgtcaagtaagtcttccagcctgtaaaacatagaatcccctgcctaaaaccctctagtacccttaactcaacctgcttttctccacagtgtatgtacctgacagggtgtatatttatttgttgattgtcccctacactagaatataaaccttcagagcaggggtttttatatattttgttcactattgtcttcctggtttcctagaacagtcagtgtcatagaataagtgctcaaaaaatatttttgatagagtgaagatacaatagtgtctggtgcagtgtgtcattgttatctggttactcttattactacaatcactactgttacttgttactcttgttactacaatcactactacctaaatactggagagatacccaagaaactaataaaaatgggggataggggaaaaggatagaaaaaaaactgagaaaggagtgacattcctcattgaatgtcttttatactgtttgtgtttttaaactttgtaactttaatgcctgtaaagaaatcagtttaaaaatatgctgatatggtttggctgtgtccccactgaaatctcatcttgaattgtggttcccattatctccatgggtcctgggagagaccaggtgaagataattgagtcatgggtcctgggagagaccaggtgaagataattgagtcatgggggccatttcccccatcctgttctcataatagtcagtcagttctaaagagagctggtggttttaaaaggggcttcccctttcactggacactcattctctttcctgctgccctgtgaagacgtagcttccgccatgactgtaagtttcttaaggcctccccagccatggggaactgtgagtccattaaacctctttcctttacaaaatacccagtcttgggtatgtccttacagtagcatgagaatgaactaatacatatgcctaccaaactgtcgcagccaagcggagctaaggagatggacaactcagtgtgagatggtgaccaagatgctcttaagcttcccatcagcttgactaaacaccaggcaggcttctccagtctctagatccctgacctgccttttcttaaagcatttactttagaaacttgcaattgtaaattctttctctgcccctttaagacataaatcttttataaagtttcttgccagttttacaatctaggactgtctttctcaaggacgtgggagctatttctttgaaatgtaatcatcaaggaagacagtacccctatctcttagtctttgtggaagggtggaagcccaacttccatggacaccaattagcaaacacagatggcctaatcacagagaaatacatttgcaaagtcaagaataactcaatgtgctggacatatcctattgttcaatctcctaatgtcctccagtacttttccacttactccagcaattaaaaaccctcctgtccttttcagtttcagtgaaattgagttcagacctctctccttcctctattgcaatagccttgaataaagtctttcttgcctgtttaacatcatccagtgtcattttgctttgatgtctgtatgctgaatgggctcctgtatcagaaaaaggacatcagataaaaactaaggaaatctgaataaagtatgaactttaggtaataataatgtatcaatattgatttattaattataacaaatgtaccataaaaatataagaggatgctatgggaaactgattgcagggtatatggaaactctctgtactatctttgtggtttatctataaatctaaaactgtttaaaataaaaaaatatatttttaaaatcctatctgaacctggaggacatcatgctaagtgaaataagccaaacacagaaagacaaatactgcatgttctcacttgtatgtggaatctaaaaagtcaaactcgtattagagagtagaatggtggttatcagaggcagggggtgggaagaagatgaggaattgcggggagatgaagaatagggagagattggtcaaagggtacaatgtttcgattagacaggaggagcaagttttagtccattgctcagtgtggtgaccatcgttaataatggattatatatttcaaaaatttgctttgaaaagttttttaatattctcatcacaaaaagtatgtgagatgatgaacatgtttattagcttgatttaatcattccacagtgagcacatatgtcaaaacatcacattctatctcataaatatatagaagtagtatttgtacattaaaatatatattaaaaataaccctatctgagtggaatacggaaaagaacatccaagtgtcagaaagatccagtaagtaaggctctgacaccagctatgtgatgacagtcaagtcatcagatctctttgagacccagttacctcatttataaaatgacacttgcaaatccactaacatcatgcattctcagtagtcgcagaaattgtcttagacaatacaatggcttgtggtcctccaatgtctaactctacccaataaaactgtgacccttagtatttaatttctctcattaagaagaattcaatcctattttttttctatgacaaggggtgacagtaaaaaacaagtttgaacacagccttagataatacaaaaaataaaaaagtatattactttccctttacaccaacattagaccgagttttgttcagcctgaatccccagaacctgtcacataataagctcttgatgtgtactgattggctggagcacaaagctgaagcaaatttaattgcaatttagcttaattctcaagctgtgtttccaccttctttgcaaatacagctgcaaaatgcctatatggtctctgggcttgtttattcccagtggctgggtcctcactaactcctaagaagtagggaattaatcgaaacttacagggatatcctttagagcaactttagttctctgaaccacggcatgacaagtaagaacaatcacttcatcgtctttctttcctcctacactagaaagcatcaaaaagaaagggaagcagcctcaaggtcactgggaactcagtaaagaatgaagaggctgactcagggtttaaggttctttcaaagtcctcaggcatacaatgaattaaccagccctgggctactcaaatgcctgtagctttgactcctggcttgtgcctgctaattaactgtccacttaatgggctcctctgaggatctcaggcaacataaaaaaataaatgctcattttggactcttaaaagccacctttgaggtgttccactagattatcattaatagtaattattcagtagtgatgttacataaaaccccagccactgcccttggagctttctgtataaattcacatccaataaactgtgatcatatctttcattagaactgttactacatacatttcaattcagggcatctctttgaaataaaactatttccttaaaagttaattttcttgatacacatgtgtgggcttattaatgtgaccttagaatagacttactgtttcatttatctggaaggaatacaaagaaagtaatgctggcaaatttgcatctcacatgatttcaagtgtgacaggacgcacactacaacacaattttggagtaagtggtatctcacagatccctggattcatgttgaggaaaatgtcactaatactcccacatctttacaaggcatcttaacctgacttttctctttctctttttttttttttttttttttttgagatagagtcttactctgtcacccaggctagagtgcagtggcgtggtcttggctcactgcaacatctgcctccctggttcaagcgattctcctgcctcagcctcccgagtagtttggattacaggcactcacaaccacacccagctaatttttgtgtttttagtaaagactgggtttcaccatgttggccaggctggtcttgaactcctgacctcagatgatctgcctgcctcggcctcccaaagtgctgggattgcaggcgtgagcccccacacccggcctacccttacttttctcatcacctctttctcctcttcataattctcctgtgaggcaggcactgttatgttccctgacttcatggtgagaaaactgaggcttagaaaggcaattagaaggtgcaaggtcttacagctagtaatggccccctttggtgcttacatagcctttcctgttggaatgtccatcctccgccctggcttccttacctctgcaatcccatccctccaccccttcatgacccaccttgactttcacgtctgcagaccctctttgttctcatttgcctggaacactccctcacatgctaactgttactctagcctccaggtctcaggaagcacttcttccagggagtcttcgctgcctctcactgagcaaaatgcacttgatgagtagtccttctgcacaagaatagggacgtcaactgtcttcttctctttatctccagagattttttttttttttttgagatggagtctcactctgtcacccaggctggagtgcagtggtgtgatctcggctcactgcacctctgcctcccaggttcaagcgattctcctgcctcagcctcccgagtagctgggattacaggcatgcgccaccacgctgggctaattcttgtatttttactagagacggggtttcaccatattgaaaagaaaggaaaaagaggaaagaaagaaagagaaagaaaggaaggaatgaaagaaagaaagaaagaaagaaagaaaagaaagaaggaaagaaagaaagaaagaaagaaagaaagaaagaaagaaagaaagaaagaaagaaagaaagaaagaaagaaagaaagaaaagaaaagaaagaaagaaggaaaggtctcaaactcctggcctctagtgatccacctgcctaggcctcccaaagtgctgggattacaggcgtgagccaccgcacccagccctatctccagagatttataagacctgatatataacagatgttcaataaaaactcgttaactcacaaatgagaactagtggtaaagccagggctagaacttctgacctcaagttcatttctgtcatcatcttattccctcttataattaataaaacaataacagtaacaaatgacttctgaggtgtgatttctttcttgagtgagataccaatgtggattgaccataatgtaatacagtaaaatttcagtactgtggactccattaagaatgcataatgccttgaccagcagctgggctggctcataccttagaagtgtttatttataaaagagattgctaagcacattagtgcattagcagtgtaaacaagatcatgggggaaatggcagaagacacttaagagaacaaactgcctggagtcactttggaagcagccattatgaacaaacaatcactgtgctaattacaattgctctgctaattacaattactgtgctaattacaatctaaccttatctgttcataggttccctaaggacttttctttctgagcgtttagaccagcctgagttacggcctgcatttgagtgtaatgaaattgcgcttctttaaaaattgtctctgcttcagatgtctcagtgattcagataggctttccccttctagaaaaagaacacagtcagggattttgaagccagaaatttaaaacaaaaccaaaaaaggggggaaagcgagctgtgaagacaagcaaaatggatcttgttgattttgttgttttagcacctcttgcagtctagagacacatttttaggttagttggagaacatttgaaatatactctgtataatttgttttcttcataaaatgaccaggtttggtatatttagagatgttaacattgagaaaattttaaaaaattaaagtggctatttttctttcctctcttaccataaatacggggaaagattacagagggcttgtttaaaaatggatcccaattccctgctccccattaaaaaaataataataataaagaacatctttcactagatcttaattttactacttactttctatccccagtcaaactaatgggtgttgatgctatgagatttttgtttcagcgcttaagaataataaagcttcacccaggccaatgtcttctcctaaatggatttctcgctactcttccaggagtttgtcttcaacctttgacctgaagcagaatgcagcccagcactctgctggtaagtagctttctgctgcatccaattatggctgaaattgcagcgtgggcacatagaggaggctctaatccaggcacccaaccgtggcttcagcacctgggacttagcagcctgccttcaataagtgccttctctgttggcactgatctctaagcatccctgtgcccatcagatagcagagcggatgaacacaaaataacctttgctacattatgcaccgggggcctattggattgcaggagaggtctgtctcccctggctgctgcaaaactgaaacatattctctgcacttggtcactctagagaggattatacgcagaagacttctttaagattccatggatctctagtgccattggccttgggacttggttcctgctttcaaactggcaaatggaggaacaacaattcttcattctcaggcataacctaggcagctcgtgtttccatctagcatttaagttcagtttaacactttgctattcaaagctgttcctctgtactcatggacataaagatgggaatagcagaaactggggactactgaggggggaaggagaaaggggacaagggttaaaaactgaatattgggtactatgctcagcacatgagtaaagggatcattcattgcccaaacctcaggatcatgcaatatacccaggtaaaaaacctgcacatgtaccccctgaatctcaaagttgaaaaaaaaatttaaaaagagaaacaaacaaaaaataataaaataaaacacacataacaattaacccaatcattctattcctaggaatttgtcctacggatatattagtatgctcagacatatatacataaaattgttcactgaaatacgttttggaaaagccaaaaactggaagcaacctagatgtgcatgaataaaggagtggttaataattatatgattcaatcattcaacacatattcagcaggaacgggggacacagcaatgaacaacacagacagaaatccctgccctcatggagcatatgttatccctacagtggaaaaatatggtatgcctgaaacgtaggaggaagatctataaacattgatagctctccaagagctatgagtaagtgaaaaactcaaggtgcagaacagtatggctggctatctagctagctagatatttagatcatatgatcccacttggaaacacatattttaatttgtttaaaattctggtgaatacaaaaggaacttaacggtcctttgggaaatgggattgaggtccagaaaaaacagaatcttaaatatgtttgaaaaacaaacaaaaaagctggtccttggacccagcagctaatttgaaatacagagcctcagaatttattacctgtggcctactgatgcataatctatattttagcaggcaattggtttgtaccttagagtttgagaagcactggcataattcatgtgtattgagttctgactttaagcagatatatggaaaattcccacctttagatagggttttcatgcataataatgatgagctattatttgcttcccagctcttagaggatcatatggtttggaccaggagtgtccaattttttggcttccctgggccatgttggaagaagaaagaatggttttgagccacacatcaaatacactaacatcaataatagctgatatgcaaaacaaaacaaaacaaaacaaaaataaacaccttttttttttttttttttgagatggggtttcactcttgttgcccaagctggagtgcaatggtgcaatctcggttcaccaaaacctccacctcccaggttcaagtgattctcctgcctcagccttcccgagtagctgggattacaggcaggcgccaccaagcccggctaattttgtatttttagtagagatgggatttctccatgttggtcaggctggtctcgaactcctgacctcaggtgatccacccacttcggcctcccaaagtgctgggattacaggcgtgagccaccgagccgggccaaaaacctcataatatttgaagaaagtctacaaatttgcattaggccacattcaaagccatcctgagccacatatggcttgcaggctgtgggttggatgagcttggtttagaccatgtgcatgtgcctgagcacacatgttatctagaggccatggagtgtttagaagagcagcccttcaatcctggctccattatttacacgctgtgtggccttgaatgccatgcttcctctctctgggcttcaattttctcatgtaaagcgtatgagcatcaatctgctttgtcaacatgtgtcatgggagaaatatctgcctatgcccctcaaacacaggctttgaaagggatagaaaacagttttacaagatgggttatgctttaagggtattgggaaatgaacagaggatgtgatgtggtgataataggggaagaaaattaggacaggtagtaggtgagcgagactgatgtgcagtccagcaaggcttgctggttaagctttatgctgtttgaaagggcctcctttcctattgggcaagtggcacttctatgcttatcgttaaatgtttttgtttttgtttttttgtttgcttggttttttcagatggagtttcactcttgttgcccaggctagagtgcaatggtgcaatctcggcttactgcaatctccgcctcctgggttcaagtgattctctggcctcagcctcccatgtagctgggattacaggcacctgtcaccacacccagctcattttttttgtatttttaatagagacgtggtttcaccatgttggccaggctggtctcgaactcctgacctcgtgatccacccgcctcggcttcccaaagtgctgggattacaggcgtgagccactgcacccggccttatcagtaaatatttttaatatcaccctagaggtgggagattagcacaccactgcaacttttggatctgggcccaggccctttatcaaattccacatagtaaatatgaacacttaaatcccacattcctaataagatgtgtttcattacagaatgttcagacagaaaaaaaaggatgtccctataagggacaggtgacagaacacactggagagattatgttttcccgaggctgtgattccacactgctagctgagctgtccacttcccatgaccctcacccccagagcatgaagggctgagcttctgcccctatcctgggcatttgatgaaagcaccatgtttaccaaaacatgagctgcttagaagaagttgagaggataaccctggctccagtccagaaataagttttgcagggaatgaaaaaaaacccatcttcatctgctgtatggctcctggaactggggggaaaggaatgcaatttaaggcagagaaaggaatggttattgggatcctactgtgtgctgggagctttgcttatttgcctgttaaatccttgccaaagctcttcagggttattttaaggtaaaacaccactttatagttgaagatcttgagattactgaagttaagaaatttatccaaagccacacagcttggaaagggcagacacgggatttggaccctgttagtttttaacagcagcacaccagccaggaagaggatctagtccctgcataatcctgcacatgcaagtgagctttgcttacagctcctccttagtgatgaacctggcagccctctatggcacgtgggacttctgtctgccaaggacagatatgaaacaggttccaattccatttaattatctcaacaccaggaagtgggcattgttactattattcttaatttagggatgggggaaattgaggcttaatgaaataatgtgtctatagtcacacagttggccaagctgggactctgagtccagagctggcctcttaaatacaaagtcattgtatcccaaaattgttggatcatgtgaaccacttggaaatactggtaaaaattcgctttcccgaatcccttttctgggaaaaatggtgggtcttggtgcagccccacgtgattcttatgatcaggtgaataggaaaagcttccctaagctcctggccataggagttgagtagcaaaaatgctatgttttgtgtcagatgctctcagcctctatctgatatttgcattagccttaatttacagaagaggccacagaaaccagggagaagaatggccaagggtgatacagcaggaaatggcagagcagtatcagaaactcataggagcagagagtagaattgcagttgtcaggaactgggtgaagggaaaaatggggaggcaaggactaaagggcacaaagttttgggaacagttttattatgcaagataaataagttctggagatctattacatagtatagtccccatagctaacaatactgtattgtagactcaaatttcactaagatatgttaaatgttttgttttgttttttgagacaggatctcacagtgtcacccaggctggaatgcagtggtgccatcatggctcacggcagccttaaattcctgggctctagtgatcctcccacctcagcctctcaagtagctgtgactactgctgcacaacaccatgttcagctaacttaatttttcttttttttttttgtagatatgtgatatcactataatcctcagactagtcttgaactcctggcctcaagcaatcttcccatcttggcctcccaaaatgctgggtgttaaatgttcttagcataaaaatctaaataaacaaagagggtgggagaaaactatggaaggtaatggatctatctatggccttgacggtggtgatggattcactagtatatacttatctccaaactaatcaagttgtgcacattagataagaacagctttttatatgtcaattatactttaataaagtggtttgaaaaaagaaagttagctttctgattccagcccctatgctacacccaacactggtcttgattcctgcagaagatgtcagaaaaccttggaaacatggagccacacaaaagaaaagaggtttttttttctgcaaccagttcaggagtcagaatgccaggaaaattcaccccttgactcctctaatccagcctccaactgctgtcctcagtgcacttctaagatcttgccaatggtccctcaaagaaggcagcaaagtgctatgtttccaagtgacaagttgaggattttgctaagagcttgaatactgcagaatattgctccatagagaggcttgggaatagccttgaaaatcagaagctaatgcctccttttaattaatgctgtctctactaacagcctcttttgctttttcttatttcaatgagatcatcgtctattataaagcacacagacctgagagtgcacaaacacaactttccaggcctggttctgccactaattctctatgggaccttggcattggtgctcctgtacagtgtcagggttggatgccatgtctccaaggcttcagacagaatatagtgcagacaaacagactgagcattgaaggactggcttattcatttattagtgatacaattttaggcaatttacttaaccactgtgagcctcaggtatcccatctacaaaaggggagagtttagccaggtgcagtgactcacatctgtaactacagcactttgggaggctgaggtggaaggatcacttgaggccaggagttcaagaccagcctggccaacatggtgaaaccttgtctctactaaagatacaaaaactagctgggcatggtggcgcacgcctgtaatcccagctactctggaggctgaggcaggagaatcaggtcagcccaggaggcataggttgcagtgagccaagatcatgccactgcacgccagcctgggcgacagagcaaggttctgtcccagacagacaaacaaacaaaagaggagagtttgttcaaattgttctgcaaggcttttccagctataaattttgtggttcttcagtaactgaaagaaagaaattgacaagagaatagaatgatgtagtatagttctcagaggctgcaatatgaaacaggagagtgctgggagccttgaaggcatgactgttaagtgaactttggtgttaaacccagatgctaccactttagctgtttgactgctaggctagttagcctaatctgtctgtgcttcagtgtcccacaaatatgtctgtgcctttgcttctcagtgtcttacaatgtgctgagataagacagcatgtcttatcgtaagatgcatcataagatagcatgtctctgtccaatcctttgagatagcaatgggacttaatttgaccagaaatagaagcagaatttcactgctaggagaaagttatgatagccaagtttgtttctcactatgaaagcattaatggaagcacagaaaggtgattcttctgtcagtccagatttccgaacaccagaatggccagggcccctgccattcagggagaggcaggtggtatgaccaacacataaaaactttcacagtcaggccactgaagtttgaaattgtttgttcccaagacacaaacgaatgcattctgactgatacattcatttccttttattcataaagccaagttgttaatggctcctttgcaataggtgtgaaaatatcaaatgaaaaaacacataaagtattcagcataggtccagacacataaaaaatgtacacaccattaaaggggcggggggagggaaagaggtggaagggaggggaaagaaggtttcagaagcagcatgtttaattaatcacctcttaggaaggcactagaaaaatcataggccacaacagctttggagaccacttaataagaactgactcagtatcctcagtgggggaatgagtgagtgctactaacaaacaccagctttccttgaatccttatagaaagcccttcagtcttgccaagcgtgggttgtgggtgctgaatccccaaatcccacatcttaccccaaactgtcctcttatgctatacaatatgcacatctgataagcagacaagattgaaaagtccctttctaataaatctctcatgagctcctccagctctttgcaggtcattcttgagggcctattggcaaatgcctactgccagcagacccatcttatttatgatgaggcttttgcaaaatctaccactgtaatttgctcagtccccattcccaagcagcttttccttcctgtcatttctgagacaccaggttcaataatagctcttgactgatgtttatctaaatctctgcaatctataaccaaagtttacctttcttccttataggaatgaagtagaatgaatgtgggtaagagagtggggggggggagaataaaaaacaaacaaataaacatcaaataccaccaatctttggtgagtttatctcacttgaatagtctgtcaattcccacactgatcaagagcaaaggaaaggggattctgacagtgaccctacatggatcactgagaccaacacttagcaccggaagggataagaaacaacaaagcttgacatcacttaatggatttgggggcaatttggaagtgaaatcattggctcttcacatttccacagaacttgacattttaccaaaggcttcattcatgtcaatttcaacataattcctaatccagtggtctctctcagcaccatccagtctctcaaaacaagccccattcccttccgaggaataaactgtattttgatttttgtatgaactgtgtccttctttcttgatcttttcatgtctccttcagtccttccgtcttgcacacatttcccccttccccgccttctgctgtctgtctctgtacctccttaactctgttcactgctctacatctcttcttaattctttctttgcttgctgttccctcctgctgtgacatagactgttctttagtgtctcctctgtttttgtctctttctccctgcctctgctcggtctgactgagtctccttgtcactcttgccctgtctttatctttccatgtgaatctcttaatgtgcaccatgcttaatttttgcacacagtgcaaacccttggactgttcaggaaatatcaccacatgctcgccccccagaacaggctgtagcctacatgcagtgacctgaagaggtagctccccatggagtggtctttgcctaagatccctccttagttataaatttggtctccccctgtggcacctgggtcctcactctacactgagaacagggatagaacacatggctctcctcatcacatgctgatatgggatataaagtagttgcatacatcctttattgcagaacaagaaaccagggagcactggtttgggagtcagaagctaactttcagcatgagaggagttccaatcactgtgaatattgagccagttatattatttcctgagcttccgtttctccatctgtacaagtaaggtctgaaatagttaatctttaagttcttgtctagttcagagacattacatttttaagcgctttgtaaagcagaaatctgggttgctctttcagagattcaagagaggaaatgaaaacacagacctctcttatatcagcagttgctaggtggggtgatctaggcaggggcagggaggagtacaaagcagaactgcagctgtcacacaggagacactagctggtagagagtttgatatcctaggccagccaattgtcaggaaatgaggcatatggtgagacggctggtggcagtacttgctggctactctctagggctggaccagagattacttagaggagggaggaaaggaagtagtaggaggagagaaatgacaactgcatttgatgctgaaatatttgcaggctttcaggaatgtgaaggacaaaggagctccatcctccctgctgtctggagctcaggaagggagacttgaaaaagataaatttacggctgggcggggtggctcacgcctgtaatcccagcactttgggaggccaaggggggtggatcgcgaggtcaggagtttgagaccagtctggctaacacagcgaaaccccgtctctactaaaaatacaaaaaattagccaggtgtggtgtgtgcctgtaatcccagctacttgggaggctgaggcaggagaatcgcgtgaacctgggaggtggaggttacagtgagccaagatcatgtcactgcactccacattccagcccaggcaacagtgtgaggctctgtctcaaaaaaaaaaaaaaaaaaaaaaaaaaaagaaagaaagaaaaagaaagaaagaaaagaaaaaaaggaaaagataaatttagacccatcagaagtggcttgcctttccacagtggggaggcaactgacttagcatggttccaagaggatacatggtctggagatggaaataattgcaaagaaagtttagctgaagccaaggacgacagagcttaaatggaatagattgctctaatataatggtggtagtcttgggagttttctaaatcttgagggtcatcaaaagagaaaatcctggtctgttcactgtactcccctccatgggcaaatcagggcacttaggctctggctgttcagaggcaatccagggttgagaagttggaaacaattagcagagtatttgaggcagaacaatgacttctaatggacctaaaattgtgtctgggactggacagtcagtcctaggccagcctttaaggggccatgttctttctttctttctttttttttttttttttttttttgacatggagtcttgctctgtctcccaggctggagtgcagtaccactataggctcactgcaagctccgcctcccgggtttacgcccttctcctgcctcagcctcctaagtagctgggacaacaggcagccgccaccacgcccggctaattttttgtatttttagtagagacagcatttcatcatgttagccaggatggtctcaatctcctgacctcatgatctgcccgcctcagcctcccaaagtgctgggatgacaggcatgagccaccacaaccagcggtgccatgctctttctcactgacgagtctgttggccgtgggaagataagcactccaagcagtcaggagaactgagaacgtgggctggtcccacaatgacttgctttgtgaccaagtcctttccctgcatgtaaaatgagatcccaggatttaatgaagtttgttcaggatctagcctcttactacccatgtggatccttcttttggaccaagctatccttcacacaacagaatggtacattggctcaattatcaaatgccagccactctgagagctgctgtgagaaatgaaactccataaaacatacaatgtacctatggaaatggctggcttctgttaaaagcaccccattttaaagatgaagcagtagaattatgcttctcatgggtggggctgggatttgaaggcatgttcattggcagtctgttttcttgactcccacccttgcttatccatatgtctgggcctttgcaggctccttcctggacaggaaaatgccctttaactcttatctgtcccaagaggcactattctttgctatcacttcaaacctcagttcacaaactttgtcctttgagaagccctttatctttccttctaattcctttcaacaggcttccatgggaactctttggaaaccatcgtctttccttggaacactgctttgcaaattaaatttttctatttttttaaaacttgtgtgtgtcatcttgcaagcttttaaatttcttcctcaaagagaaggaataattcctttatttttttattttgtattccaagcaacattattctatccatgatgttgctcaagacacactttcatagaccattaaaattatagaaaactagtattgtagaatctcagcattgaactgcaattcatccagactatccttaaatttttcccagagcttttcctgatttttgttctttttttttttttaaatagagacaagtgttcactctgttgcccagactggattgcagtggcatgatcatagctcactgtaaccttgaatggccaggctcaagtgatggtcctgcttcagcctcccaagtagctgggactacagacatgtaccaccaagttcgaataatatatatatatatatatatatatatatatatatatatatatttttttttttttttttttttagacggagtctcactctgtcatccaggctggagtgcagtggcgtaatctcagctcactgcaagctccgcctcctgggttcatgctattctcctgcctcagcctcctgagtagctgggactacaggcgcctgccactacgcctggctatttttttgtatttttagtagcgatggggtttcattgtgttagccaggatggtctcaatctccttacctcatgatccgcctgcctcagcctcccaaagtgctgggattacaggtgtgagccaccacacccagcccagtttaaaaaaaaaaaaagttagcagagatggagtcttgcaaagttacctaggctgttctcaaactcctgggctcaagtgatcctcccacctaggcctcccacaagtgttggaattacaggtgtgagccaccatgcctggctcggagcttttccagtaaagtagcattcagtctctgcttgagcaactgagtcatggatccacctgccaacgatacctaaagtgtcagaggggccatttctatctccttttccatcttatgcccaataaccagcatggtatatgagaaagaggagattctcaaagagtatatgatgattacaaggatgaacggttttagtgaattcacatctccattctcattctgtaaaatgggagtaagagggtatgctgaattgaaatacaagagcaaggttttagagtcagctggagttacatctgattcctgactctacctcttactagatgatgatcttgagaaagtcactcaacctctctggattaatttctcaattgtaaaatggaggtcatagtgcctccagtgattctaataatgaagctaaaatgaaattatcttggctctcctacttcctagaagggagtctttggaaagctactctagatttctctttctcttctgtataaaaaggatgataatgactcctgcctcacaggatcattgtgaggattacataagttaatagacaaaaaatacttagaaaaccctttcgtgtatgctgaattaatgttagtggacattattattgttagtagttagtagtaaagaacttgacacagaataattattaataaatggtaaccatttattaccactcataatacaattatcactactattagtaagatgatggaatggaaacaatgattattataatggtgacttattactagttctgacttttattgatatgacctcaaatgattaggagagccttgctttgtgataatatctttttttttatgcaaacatggttaaaagtataatgtgtgtgtgtacgtgtgtgtgtgtgtgagtgtgtgtttagataatccttctccatacatacaacaaatctcactctactagcttatggttcttcaagctttgaggcataagtaagtcaccacttaaagtttctcttctttaggcagaacagtttcaactgtccaaaaaccctttaccaatatcttgcatctttaatcctcacataatctggccaacctagccgtcactcactattgagtgaaaaaagcaatttctaaacagctttactgggatttggggagtgtgtgtgtgtgtgtgtgtgtgtgtgtgtgtgtaggcagacaggaaaaaacagagagagaaagagagaagtagaaattttaagagcattcaggaaaatgttaattctaggtatttctgggtgatgcgatttttattttctactacattaaatgtccttatttttgaactgcctgaacagcatgcataaaatacttatttttcagtagactgaaagattaattaatgtttttcaaaatgccattaactgtacttatatgataatttaagattgaatttaaaatgtggggctagaactaggaaaatggcaaagtgggacaaatatatgctaggaccatgaaaaagaaaccttatggaataaagtttgatgactttccacactccttaagagggtacctgtgagcttaaagtgatgctggccagaataacaggtctctaccccattgtgcccatggcttcctccctgtgcccaggttgtttgtcagtgactcagacaagcaatgtgcaagtatctacagcatacctaaaggtcatctggaagacttggccttggttcacatgctgggtccggttgttgtaaccatgtagcatctctccaaagagggtatcattgaatttggagtcaggtttgaggcacttggggccctcgcagacatctgagagcattaagcaggattttccatcaggagccagtttgtactcctccacgcaactgtatgataaaacagagctcagaattagcttcacatcctgaatgcccccattgggggtgacctaaaaccaaggcctcctttccctgcaaaacaggtcagagtttaggaaggagacagctattctacctggaatctatctagggcacagatgtctagagagaagcacattaatactgcaaattggtaaattcaaggaaagtcatttgtgacattttggaggagtcaaggggacaccagcgtgcacgttcacacacaaagcaaatttaaagactgtttcccatgaacatacagactttaaaaagcatgacataccaattcacagggaatcatcaactagtgtctcaaaccagaatctattcccagtacatctgtcaaccaaggttgaagactgtagcaaatacaaggtttttatcatcctggtagctcagaggtgaaaccttccaggaccatggacagcacaaggcttctgttcacttagggattttagcagcctccgttggtctaacagccagaaaagcccttgacaagcctttgagacaggggtggcctcatctatggacaaaacaggcatctgaataaggtgtggaaacaatatttgcaatttgaaaagatttgcagtgacaaatctcagagaggcatgggctggaggggatggggatggttggggcaagaaatcagagatctcagcccctgaaaaatcattccagaaactggaattctatgagtgtctaccttttcaaagttcagcgctaagcactaggagtatggtgcacataaataagacagacaagagaatggtctgtgagattggacagacctgtacaaatgccatttttctccttgtgacctatatgaacatgagtgagtcatttaacttctatgatccccagtttcctcatgtgtaaaatagagtagacacttctaccttaattcagtaggatgctataaggtcacatgatacattggccacaaaaaaaacaggaattgcaatatacttaacacaataatcataatagtggtagtaatggtgttatttctatttattgagcatgtactattcactgaacactttatgtatttattatctaaccatgaagaaagaaagagtaatatcataatttctgctttacacataagcaaaataaggagccaagaaataaagcatatagtactgtgagtaagtagcaaagttgatattcaaattcagttctgttagaaaaagggatgtttgtctatttttgtctcctccaaatctagtgctttctatgtgcacaaaatgaccctggttggtatgtcagtttgagaaagtaaacagcaggcaatctcttatttgccttttttcaaagggtgtagcaaagattcattgaagctaaccgcaaagggactcaggaactcagatgggagaaggaagaggctctgtatggtggtttggaaagaaaatgtacacaggttgtgggaaccagtagctgatgctacagatatagagctgaactggaggcagaaagaagacaagcatagctggaaacctgacccaagatcactctagtgaaaagccaggaagtctcatgcatgaagcaaactgtcactgtttccttgctttcccctaatccctggcgtactgcactgatgcactgatggtctttctaacgttcaaatgttcctttccatagtacagtggggaaatctcttggaaaagggccctgtctcagagccttggtaaagtatatccccttctttttgcatctgttaaatattactaagtcccttttaatacagttgcagtgcagatgaaatgagtgtatatggaagtgaatcgtacatggtgagtgtttcataaagtctagttccatccatttattgagaaaatatggagaaatggtttactgggtacactggctagagttctctctctctctttatttctctcaccctccacacatacccacatccctgtgtgactgtgaataaatatattattgttgaagatgagtaaacattatcaaagtctggcagggcgcagtggctcacgcctgtaatcccaacactttaggaggatgaggtgggtggatcatgaggtcaggcgttcaagaccagcccagccaacatagtgaaatcctgtctctactaaaaaaaaaaaaaaaaattagccaggtgtggtggcagccacctgtaatcccagctactcaggaggcggaggcaggagaatcacttgaacctgggaagtgggggttgtagttagccgagatcatgccactgcactccagcccaggcaacagtgtgagacttcgtctcaaaaacaaaacaaaacaaaacaagacaaaaaaaccattatcaaagtctatagagtaaaatatggaacttcttcatttcccactcctcactttctgtcccagaggtcaccattgttaatttttatgtgctcttccaggagtttttcaatgcatttaaatacatattgtgtgtgtgtgtgtgtgtgtgtgtgtgtgtttgtgtttgtgtatacagaaacatttctttgaatctgtcgactaaattggggggatttatataaacacacatatgcacacacacatctcataataaactcataagcagaattacactatatattgttgtgagacatgcatttgcacctgatgcaatttcttggagatcttttcaaaacactatatatatagatctatctttcttaatggttatttggcattgcacagtataaatgtaccataatgcttttaactaatttttattgatgggcactttagctgtttatagctatttgttattacaaacaatgccataatgaagatctttgcacatatatcattgtgcccaactatgtgtttctataaaacagatactcagaaaagaaattgcttggttaatgttttatgaattttaaaattttgatagatctactaaatagttgcctgtagaatctctacccgtttacaatcctataattgatgaatgggagatcctatttttctacatctttcatgttcattactgccaatctaggataggaaaaataactcatttttgtttggatttgcatttcccttgttactgattaggttcagcatcttttcatgttacggtcacttgcatttctccttctatagattatccattaatatgcattgaccatttttctattgtgatatttgcctttttctttgtgttggtttatatatgctcaatattttctgggtagttatccttcaccttccatatatattaaaatttttttccagtctgtgcttgtattttaatcttgcttttgatatcttattacctctttcttctggtctttgtgtctgaaatttgtgcaatgtttagaaacccacaagacgataaaatatatttctgtatattattgtagtattgtatatgtttaaaaaaatctttggttatttaatatgcatggcatttagttttgaatgtagtgtgagtgtttattttaacttaactattttttaaaatgggtagccaattgtctgaagtgtctgacctttcaacaacaaatttgaaatgttattttttttttacacgtgcaatccctacatatgccatatatacatggttggtgtttttcctgtttaattatctgtatattcctgcagtaattccaagctgttttaattactatagctttatagcctgttttggatatagtaataaagtaatactcctccccttcatcaacactagttttctatttccaaatttcctgactgctcttccatatttttcctttcaaatgaatttcagaatgggcttatcaaattatatgcaaatccctagtggaattttgggtggcattgctttgaatttgtaaactaaattgggggaagattttaatattaattttatttcattttcttttatttaatatatacgttttgcgagttaactctgtgctgggcgcttctgataagtgtgacaaagacatcttgcattaaccacactgtgtcctcttcctggacttgcattgcattgggtcctcttcctggacttacatgtctaagcctgtcttgcagttgggctgaaggggccatgtaactggattctgaataatggaatctatgctgacatgattcaagtcactgccagaattagtcttttcaaaacatcctgtgatttttcaagctgcctcttcccttgttatggcaagcttggagaccatgcgttcccgatgcattctacaggatggaggaagactgccacaattacaatagaccgtgcacaaataagaaactagcttttgtgcacaagcttctggttgggggagggggctcatttgctacaggaagaaagcttatcttatcctaatacagcatctttataatttggagttctctaactgagaaacagtttgtatctctatttatcaactgttcttttaaaacatttggtgaagtttttgactttttgttataaaggttttgcacgtgtcttttggaggttattcatgggcatttatgaaaggcactatgctgtagaggtttatcgaagtatgttttggatccagactaacagagtccaaatgctgagtctgccacttaccagttgtgtgacctcggacaaactacttaacctctctgtaccgcctttgcttatctataaagaagatcatgtgtgccttttagagtgaaaattctactgttgcaatcttttaaacttcagaaataggatcagtttttcatttatgctttcttttatgttttctacatagttattactgacttgagaaaagctgttactgatttttcgaagttgatgttgcatcctacgaacataaagaacttaaacattctaacatgtctactaaatttttctaaatggagagcatatatttgctcagtttgggtattaggattatggaataagttaaaaaactatccttttttgtttctttctctggatcagtttatataagatagatgttatccattacttgataatttgataagtcttgcctataaaatcccctgggctcgatggcttcttttcagttgtagatatttagctcttatcatttatttccttattatctgcctatttagattttctatatcctcatgactcaaacttcgtaatttatattttctaacattataatgtattttatcaagactttcacatgtattggtgtaaagttctatgcagtgttctcattaaatttcttttatcttttatgtttctatagttaaggcactagctcattcgtaatgtgttcgtgttctttctttgctctctcctttgaataggctttttgtattttgtattttattggtgagctcccttttttcttttctatttaatttatttcagcttttatttaattccttcctgctgttttatctgactttgttttataattctttttatggctgcttaagtcaaatgcctcatttgtttattttcaatctttcttgcttcttaataaatgtcttgaagcttctgactgtggctttgcccacaccccataagtctgacgtgcagccctcatgctcctgctcatttctaatgaggtgaaaatttgagtttgattttttccatatccaagtgtcacttagaagatatttaaaaatataattccaaaatagataatttgtttgttcctctttttctaatattactgcatttttagactaacagtgtagtttgtataatttctatgttggtaaatttttgagattctaaggtagtcacaagttgagattttagagctaactaaacttgagttcaaatacaggttgtgccatctaccagttacatgaccttgatcaagtctgctaatttccgcaggctttggtgtcataatctattaaggaaaatgacaatccttatcatggggatgtgaaaattagagataacttatacaaaagatgaaactgtatctctcatatagtattcaagtaatgcatcagctattatgcttattattgttattgttgttgttacttagtccattaacccatttacatatcccaggaagtataaatttatttctattggttctcatatcctagttgctggcctctatctagatccagatttctgaaagttgacatagttgccattctttgattccttttttgtttttctgctgcttcacagtgtatgtttgagaacttcttatgttgcattcattggaaataaggtatacatataatttgtatatatttttacatgtggaattatcatatagaagttaaatatatgcattatttgtgtgtgtgtctctgagtgtgtgtgtgtacatacacacgtatttgcaaagctcagtcccacattcaggatcccaaagtttagtggaatgcttttgtatatatgacctggtttgctccttataacctgtaataggtagaataatggcctcctcaaaatgcccacatcctaatcccgaacacctgaggttatctgacatggcaaaggagactttgaagatgggattaagtaaagaattttgagctggaaagattatcctggattacttgggtgatctcaatgtcatcacatgtttcccataagagggagataagcgtgttagtcagaggaggaaatgcaacttagaagcagaggagaataagaggggagcagagtaacggaccatgagtcaatgaatgcagatgctccctagcagttggaaaaggcaaggaaatagatcttcccctaaggcctccagaaggaatgcagccctgccactgtcttgattttaagaatattgaccttgagaactgtaaaataaagtgtgttattttaggacactaagtttgtggtgattcattacagaagcaataggaaatgtgagacactcacagggaggtattgtctccactttcagatgagaaaattgaggtttacagaagttgagtgacttgcccatggaggtatgtctagtcaatagtggtgctgggaatcaaaacttaggagctcaagacgtgtgtgtgaatgtgagtgtgtgtgtacgactttaagcatatcacaactgtggatttacagtgatttttcttttccctgtgggtgggaaaagattgtggcttgcaggagagattcagggggaaaaaaattcccatccttgtaaaggaaaatgatcccctgagttttgaaacaggagcagttctcccccgccgagccacctaagggcataggaaggtttatgctaaggtctatttagttgttgggttttttttaaattttatttttgtactatgacacataattatatagcttctttagaacattctgtcatctgggagattttcctacagaaattctaaagagtgtaggctcacaggaaaccagccaagatctacatgaaactctatttatacatgtgccaaaatgaaaaatataaaataagtgcagagatacataccgggcattttagctgaaggcaatggatgtgttacccttaacacacccatcacattatagagaataccaaaactagatgggattttagagagtgcaccataaaaccttctatgtgtttagctcagagcatgttttatttaatcctcatagcaacattgtgagatgggtactttcattccaacattgtcacagaggatcctgaggcttgggacatctaagctcactaatcaaggtcacatgagcattttggaaaagccagaaccttgacttgggtcttcttactccaaatcctgtgctccttccagttaattacaaatgacctcttcctatctgtttgttgtttgaaggagaaaattgagactgacagacaaatggtattgtgtacaaactctcaaagcaaagtatttctttttctcatgtattttttccttatttattaatttattcttcaatggtttgtggaatcaacagaattatcaaaatacatatcctagaaactttttgaaaataaggaaggaatcaaatccttaaaaatattaagaataggccaagtgcgatggctcatgcctataatcccagcactttggggggctgagactggcggatcacctgaggtcaggagttcaagaccagcctggtcaacatggcgaaaccccatctctactaaaaatacaataaattagctgggtgtggtggtgagcgcctgtaatcccagctacctgcaaggctgaggcaggagaattgtttgaacccgggaggaggtggttgcggtgaactgagattgtgccattgcgctccagcctgggtgacagagcaagactctgtctcaagaaaaaaaaaaaaaaaagagagagagagaaaagtagttaagggtaagaatagctcaaggagctgcacaacaggtagacttggaccaacgttaggaataaatctaagtatcctattactaaggcaagaaaggaacaggttccttcccagctttcctagtgcagaaacctgtgaaaaccccaccctgggatcatcagggctagaaccagcacctaaggaactcaactgcattaacccttctaactgatatcatgggaatctttttcaccaacaccctcaggattgtcccaacattaaccaaacgaagatcagaggaggtgttctctgagcggtcttgggttgcaggttttattcaagggaaaatttagagtttctagaaaaagaaaagaaagaagtgaatagaaaatggaattccatgggaaactctggattaattatatagcagattttatctagtctaagacccctaataatggtaagaaacactctcagtttacataacactaagaaagaaacaaggaaaaaaaaaagactgccaaataaactctgtcaaatcattaaaactaagataccttcccacttcagaaatgttaaaatgtggaaaatatgggcactttagaatcaatgaaatatgtttctccactgcatgatttgggagagccttgactatccccaggcacactgggaacctgtaagaggcagttaggagtgcagatttttccacatgggaaactctgaacatttagtttgttgttgttgtttaatatttgaatgtctcatggaactaatgttccatacaatccacactggaaaatagctatccaaacaaatggatggatattacgtgtttccatcaattgtcggtgagcattttttacacctgagcttttacaaatgtttaaaaagaagagaaaacaaggttataatgtttgacaagaacctggcatgaaagtattctatgttaacgattagaagtaaaattcacgttctccaaccagaaatgaaaggggtaagggctcaggctttaacctaaaaggtggaaaccacaataaaacaagtgcctgaatgaattcccccatctcccaccaactcttccacttgttactgataatcaaaatgaaggccattgtctctgttctgtcgttcagtgttttctactgttagactagacttcagctttgacaatgaaaatacgtggcttccagttactatgcatattaaacatgtttatctcctttccctcttaaaattacataaagagaatattagacagagaggctattaaggactatttgaggctggatgtgttatttgagctaatgtgtttttagggcactttcatttaaattggaagcaagaaggttgggatatctcaagcttctatcccaattttacctcctaactggccgtgagtgcccccaccttgagggcctcagtttcctcctctaaatgatctgaaaaatactgaaacttaaaaaatgttaatgaggccgggcgcggtggctcacacctgtaatcccagcactttgggaggctgaggcgggtggatcacgaggtcaggagatcgagaccatcctggcaaacacggtgaaaccccatctctactaaaaatataaaaaattagtcgggcgcggtggtgggcacctgtagtcccaactacttggcaggctgaggcaggagaatggcctgaacctgggaggcggagcttgtagtgagtggagatcgccccactgcactccagcctgggcaacagagcgagactccgtctcaaaaaaaaaaaaaaaaaaaaaaaagttgatgaaatggctcactatctcttacataggaatatatgagaaataactctcttagcaaataacggcagaaaaaggtgtataactcctgaaaacaaaacaaaacaaaaaaactacaactttccttttctcatacaaggacaactatataatccactatgggtattttttctctttctctgtttactttggttgccaagaagcacacagccaaatttatctcatgttgagtgactctttcattttgagcttctgaaaccattttctctcccctccttaaaatggctctgatgattcctatctttatatgaatagccttttaaaaatatattgtctttatgtgagtaaaataagttctcttggaagtgtgcatggtagactctgtaaacacatacacacacacaaaacagacaaactttgttgctaggtaacttgccaaggtcttcacaggaggtgatgccctctcacctataagactggttctaaggatttattctacaggctttagcttagtgtccaatgaccttctcaatctatcttgaattcacctgcttctgtctaccattctggtacttgtgctctgtcaatatcaatcaggacccagtgaggcttaggcacctctttgcccctgctggagaagaactctactcaatgattatttgcacctaataaaagaccaggcacagagtagtcacaacaaatcttaggcggatgaattctttaattcaatcattatggttctaaataagtctttgggccaagcagtgggaatggcaatgaagacatgcagatgcctaggatgtagtccctgctcatgaggagttcacagtatgacagaaacagacaggaatgcaggtaaatcaaccaagctatgaggctatcacagggagagccatggggcctgtgcagccccagagaaaggatgatttactctgttttggagaacgtaaactgatgagagggcagccagccagaggtccagtctccaagagatgtcaagatttcactgggataaataagaatttgagacaaaatgtaaatattcctttcccttgtaggtagaaatgaaaataaataaataaataaataaatagacgagggaaaatgtcatttctatataggccctaaccccatgcaacattcagccaatatttaaatagtatccatttgaaaggatgaatattggccaggcacggtagctcacgcctgtaatcccagcactttgggaggatgaggtgggcagatcatgaggtcaggagatcgagaccattctagctaacacgctgaaaccccatctctactaaaaatacaaaaaattagctgggtgtggtggcacgcacctatagtcccgggtactagggaggctgaggcaggataatcgcttgaacccaggaggcggaggttgcagtgagctgagatctcaccgctacactccagcctgggtgacagagcgagactccatctcaaaaaaaaaaaaagaagaaagaaagaatgggtattaattatcttgttccaaggtaactgcataactcacacctgatgcctcttagggctcagagaaggcttgctgaaaaagtgatgcctgaattgaaacttggaggcgaaagctaaagggccagggacaaatgggagtcagtgggggtacaaaggagaaagagacaggagacagagggaacagtgttgtgaaaactccagaaactgaaaccaggaggcttaacttaggaagaggaacctagctggaaatgaaactggaaaagtcagactggaaacttctttagccatgttaatggaggaactttgcttaacaactattaattgaaaacctactatgtgccagtcactgttttagctcctggagacaaagtagtaaacaagagataaaatccagtaattacataattaaatgagatggttttatacttattagactaattataattatggtttactgagtgcttaactatgacagctcctgtgcatgtataatttcatttaatcttcacaatggtgctacaatcacttctaattctacatgaaagagcataggctcagagaaattgagtggcttgccaaagatcacatgactagatgtggccagaggtcagcaatgacatcagatctgtcttgactgagcctggaaccacaatacctaagtttcaatctcaacaacctcacttaccagatatgtgaccttggacagttactgagccactctgtgctttttttaaaaaaaaaaaacataaaatgggaatcataatagtaacatcgcttgtagaattgttatgagaattgaatgagctaatgtacccaaagcacttagaacagtcatggtacgtagaaagtcattagtaaatgttagctgctattattaacctggttgcaaacagatttattaaaccttctcctacccagaacactcttaggaaggtcatagagctttgagcaagttgggaaggtccccttgataatgagtttattttgttttccctgcttaattcaatagcatcccacttctctctggaccatctctctcacaagtatctgctaatagctttcattgtttacagtgcttctaacaagtgtggtaacttctcatttgcattcctaatagacagtttccaaatcctgttgaaactgcagttggttttaggatgcctgggttttgttttttgttttttttgtttttgtcctatttattaccatttggatgggttttaacagctcaccacacactctcacccattcaatcttctttaagacgctcacagtcctttcacaatatattaacagattagtcctgtctagtgcatcaggtcactagcaaatgttattagaatcacttaagttaatttatttaacaaacacatacagtgctaattctgtgcaggacattgttccaaagcatttcacaaatattaatgtaaatggtaatatatttagtccttataacatctctatagacagatattactattatccctgttttacagatgagaaaactgaggcacagagacataaattaacttgctgaaggttacacagcaaggagatgttgagccacatcactagtcatatgaccttgggcatgtttcttagccttcagagggtaacaaatatgaaatactttcctctcttcagaattatcattatattaaggtaggtattaaaattttactggtgagaaaatggaaggtcaggggtcctgaaaggcttgccttatggctaagggagagtggcagagctaggattacaattcgtgtcttttgaatccacggttccctgtaatgtgctgtggatggaaggtggtaatagtttctgatgtcaaaatccattattgctgctcctgctgctgttactgttattatttaccacagaagaacagcccccaccccaccccaaacacacagagagaaaaataacaatgacaagaacatggctgattctggatgcagcctgcagatctaaagccatgcataatttactcaacactgccctgcagtcacttaagctgaggagagatcgctataaattcaggtctgcataccctaatttatttcttatttattttgctgatacatatctagggcctccagtgagctgcttctacacctgcacaaaggcacctgcagccctaagtgcaactagggcaggaaaggagaccttgaaataagccctggaagaaaaactggactctacacactagaatcatacaagtttaattcatttttctggtaaactggaattaaacccatgcccacactcaccccctatttgtgaaacacaggactgaaaatgttgttacatgtcctgttctgcttttctatcttagtaaagacagcattaaatgtacttcttccatgagtacaagattatttttctgagtcacagaatgtcaaaagataagcaaatattctaatactaagacataatcagaaagggaatgaagagaagaaaaaagtctgttcttgtaagtgattactaaggaccaaatgctatatgcaaggtgctgtcaaaggcagaagtaatggccattgcagtctttaaatggaaagcaatgtaagttggaagaaatgtcagccatccttccccaaagatctcttttcacagatggtcaaactgtggcccagggagagaacatgacttgtcagaagtcactcagcaagttggtcccaacgtgttccccttttagcctcatacttatttcaaaagtcagtttgagtccttcaagagccagagctgtcctacaagcttcacctgtgttgtttcctttagccctcccctcctccagttaattgtccttacagatacggacattaggacacagaaaggctgaacagtgccctcacattgctacattcctgctgaaaccaagcttgaaggctggacttagcctgtgcttttatgcaccatacctgaagcctttgtgaaccttcaagacgtctgcttttgtctccaaactgcactgactaggcccatacaggtagattcagaagggcaggaggcttcagcaggaaaaagctcctggctctaggatgaggcctgggcatgggttatatttattacatttattaacccaatctttatttttctcatttttttcttttttaacccacccaacagaaggttatacttttggcttttggctcttggactaaaacaggaaaggcagaaaggccattttattgaaggtcaaggttcagccttgctgagctgtagtgtctgatcattttcccatgcatccctcacttctgtaaatggggcacctgggccttggggacagagactcacccgcagaacatgaagatggtgctcgaagtggcatcgtagggcaggggcagcgtctgctgcaggcacagctgctcacagccgccattaaagccatcagagcagtcaatgcctttggagtggtcgtagcagccagagccatccttcatgggtttcagctcctcagggcactgctcagagagagggcaacagggtagttatggcttgggaggttgtaggccccatcacaccctctcctccctcctggaagagacatgtgtcagggcctgacagaaaggtattcagtctccttttgtcagttaataactttgtgacaagttccacaagtccctttacttctctgaacctcagtgtgcccacctgtaaaatgggacttttgtgactatctgcttatagtgttgtgagaatgaagggtgataatgtcagcaaagtgttgagaacactggctcacacggcaacagcacagcaaatgtcagctgctgctaatattgatattgctgggatcatattcattattgtttctactgttattgccctatagggtctactgctagaagggtcacatagggaggctgccagatatatatttaaaagcctctaccagtatgagtgtaatttccagcttttcctcttctcactgtgtgacccgagaagttacttgccgtctctgagcctcaatgttctcatctaataaatgggcacaatacctgcaactacagatttgttgtgaagcttaagttggatcatgggggtgcataccttacttcggaatttggcacataatttggtactcataaaatgtgaattaccttccttcctgtcttgaattagtctcttcttctccaccattatccctggagccctaagtaagattcctgcatactcacatcaccatgaaaagggctcctagccagtctgctggactccagtcaggccttctcaaaaccatcctccaaatggccaacagagtgctatttctaaatagcatcactccccagcttaaataagtaaatgaatcttaaaacatgtgaagctgctataaactgataatcaaggtcctccctttatagacaacctagtcctctgcttggccatatgcacagccctccccatagccctctggtccctaagtaaactccaaggagttcaaccttcaatggcctcagctagaacgctcttgtcagtgggtctggcacctgctatgtgctccttcagtggaaaatcatatactgtggagacagatggctattgattaaatttagttttccatcatttgatgaggctgagctcatcttctccatcccagctgatggagaagtagttccaatactcctgctttcagaagagaaaatgaggtactgggtttttatttcagtcctcccgctggcatttcttgtccacaaagattaacacccagagcccagccttcctcatccatcaccggacatcactgattaaaatgccttcccaccatgagaccccaccggccaactccccgctccccttcccatgccatcgtcctaaacaacatcaataataaaacatactcacaaaaattaatttacaaaaaccacaataacaaaaaaaaaaaggtcagccctcttggaaattaaattttgcctgagaagaatttgtaattacaaatgcatgagagagttcttcaagacatttgagactggcgccaggaagagtgacggagaaagtaggttataaatggcctttgtcaagctgcagaaaggttataaaactgctgcattttgtgcttaaaaaatcaattttccatgtgagtgaagtgctgtacatattaatacaagctcagaggaagcccctgcttgtctctgaacattcactgtcagacaagagggcacctggtcacagggtcatttggagccgtttgtgagtactggggcctggcttcagtctgtttgcagactcgcggagcatgttgaaaagaatgactgattttctgaccaggtaacaggagacacctgggcagggtatggtctcagtccttcccatcccccaatgattctctaccacacttgtttttttaaacgtgttcactaagctccaggttttatctaagcgctttacccgttttaacttatttaatccctatagcaaatatatgaggtagagtggtaggctgataatggatcccaaagacatgtctctgtcctaagccctggaacttggaatctgtgaatgtgactttctatggtaaaggttatgcagatgtgattgtgtcaaaactcttgaggacaccctcctgggttttccagattggcgtaaatgccatcacaaatgttctcatgacagagaggcagaaagaaattacacacacagaggagaaggcgatgtgggggtggaacagagattggtgtgatgtggccacaaaccgatcgatgctgaggccaccacaacctgaaagaggtcaggcacagattctcctctagagcctccagaaggagcaccaccagaaatcaaatgccagcaccttgattttggatttctggcctccagcactaggagagaataaatttcttaataattatcttaagccactgagtgtgcagcaatttcttgcagcagacaaggtaggtaccgtcaggattcccactttgcagaggaggaagcggaggagagggtcacacagtttggtggtgacagaggcagagcttctcaggcttcccaactttgttgctattagctgcctaatgggcaagccacttcaccaccctgtcatttactgactgactgatctctagttttaagaagtcctgtcatttactgactgactgacatctagttgtaggaagtcctgttatttactggctgactgacatctagttttaggaagttagaataaggcagggcttagagctgatctaacctccttactttagaagtgacgcccagaaagttaaaggacatcaccccatattcctcagcacatgagcgaagaacgtgaagccaggcttcccttgccccagcttggtgttctctgtccactacactcacttcccttcaggttaaagcattttgcaaacttacatatcctatagtctctctccccaagatgatttgctgatgggaaactgaggatcagaaaggtgagggtacttgaccaacatcacacagcaaattaaaggcaagatttgatccacgcctgtgggaaaggcttcctaagtacatgaagtgggtttaccagttaccatcattccttcctctatcatggacttcaggtactgtgcctttgaggatgagtaggggcagatgagatctagccatcgtttgaaattacttgtatattattagtatttcaattagtttgttgcttactgtctgtctcctccaccaaaatgtaaatgttataatagtatggaccatgtggcttgtcctaagccatctggcacacagttggtacttgttatttgctgaacgaattggtggagtgctagaaatgacatttagtgtatctgtgtattaactttggatctgaatccacactacttcttataagttgtataaccttcaggcagtgacataaagtctcctatcttcacgtgattactgtgatgggtaaatagtacggtagccagcttcaaagatggtccccagtgattcctgccttctggtattaagactcatgtagtcccctcctacactgcaccagaattggtctatgtgaccaatagtatgtggcagaagaggaggtatgtggcttctaaaggtagatcataagagagatctttctctccctctgtctgtctctctctctctcatcacttgctctagtgaaagcaagctgccatgttttcagcagccctatggagagtcttatgtggcaaggaagtaacacctctggccaacagccagtaaggctggggcctgccagcaaaacatgagtgagcctgcaaatacactatccagccccaatcaagcctgttcagatattggcaaccccaggtgacattttgactgagactttgtagaggtaggccagaaccacacatagaagctgcttttgaatttctgacccttaaaaattgtgtgggataataaatactttttgttttaagtgacttgatttttgagataatttgttacacagcaatagctaactaatatagtgaaataaatgtatgcagtacttagcacagtgatcaacaaatagttctgctgttataggtatttgtaaagagcttagaatctggtttgagagataaatatacacatctatcagagaacgttagttatagaacaaacataaaaaagtatggtaaaatttgtttgggaaaataaaaactctgcaaactaggcaatattgaaacagggaggttttagtcttttctcctcctctaggaagggaatcctgtaggaaggaagttcctacaggaagagaaaagagacatctaatgtactagaagaggaagactagaattcattaccaggcactgtcacttgcttgcctcgtgaccttggacaagtccttgaaactatttgggactgttttctttctataaatagaggagccagtttggagacaagaatatgaggactaaagtcaggcctgaattccaaggaaagatttgtgacactgagcatataggcaggatgcttcacctcagagacagcctcaggttcctcatctgtagaatgcaaataatgtctctcttggaggcacttctgaagactgtatgagaaaacacttctaaagtatctggctttagacctggtacataatagacacctaataaatgaagaataattgaatagggatatataaacaagtaataaattaaccaaaaccccaaaagaaaaactagcctagttgggaggaatcacgatgtctgactagatgcaggtagtatgtccctcctccatggagaggaaccagaataataagtagatacacacattccaaacagattgtctagaagagaatgctaggattcaacaggggagaaatgagaagcaccagaagtaagtaagcagagactttgaggcagcttttccagtcagaaaccaactgagagctggaaggggctcccagatgtggggaaacagtaagagagaaacccccagggttccaaaatggggttttacaccttggctgtgagagaaactctcaacctactggggcctttggcctgacatacgaagtgcctaaagtttgcataaaaccattgccacagaatgagaacccaaataaaatcccacaggcatctgaacctggagtagacacagctgggcactattttgagagccaaaatactggggatctacagatatggctgctgctgccctgttctaaagagggagagggaagactgggtgctcccacacatccccaggaagctccttactgccctgctgcaggctgctattgagactgagacatggatagactgtacttcccacagcttcttgctcacctttcttgcctgagatggactctgccttctctggtatcaggcccaaagcaccgtttttgacagtttaatgctgagctgcaccctaccattggcatgagtttgggttgatgtggctgcagctgccacccagtcaaggagggacagggagaccaggctatcctatgcatatctaggacaatacccactgccctgcaaggggctgctgtgagaccaagactcaagtgggccacactcaccacagcttcttgccaatgtggctcacctgagaaggaccccatcctttctggtcacagcccacagctggcaccatgctgagcatttaatgctggactatgtcccaggcttggggccgagtttgaggtaacatggctgcagccaccaccctgctgggagagggacagagtacaccacactctcctaagcacactcaggacaatacccaccaccctgctatgggtggctgcgagactggggactagcccgcccaacccatcacagctcccagcaagaccaacacgggttgcttgagtcccagtgggttgctctaccaccatcattactgccatcagccacactacactagcttcccaggggccccaaaatctacccatacatcaggcccactgctcccactactagcttctaagcaagccaactaatggcccaagaatcagccctcaaaaacctactaacactgaagccagtgtaagctacttcggggcctaaaaccaggcacactcaccccactgctgccactatcaggtgtgaagactggctcactttgtattcaaggtcccagcttaacttcaccacaatctcaactaacaactgtgtgataatgaaaacacagtatctcaacatgtgtattatacagcaaaatcagtgctaagaggaaagtttatagcattaaatgcctacatcaaaaaattatcacaaattaacaacctaatatcacacctgaaagaactagaaatatggctgggagtggtggctcatgcttgtaatcccagcactttgggaggctgaggtgggcggatcacctaaggtcgggagttcgagaccagcctgagcaacatggagaaaacccgtctctattaaaaatacaaaattagccgggtgcggtggtgcatgcctgtaatctcagctacttgggaggctgaggcaagagaatctcttgaacccaggaggcggaggttgcaatgagccaggattgcgccactgcactccagcctgggcaacaagagcaaaactccatcccccccaaaaaaaaaaaaaaaaaaaagaactagaaatacaagaacaaaccacacccaaagtaagcaggagaaaagaaataacaaagatcagagcagaaataaatgaaatagacccaaaaagcaatgcaaaggatcaatgaaatgaaaaaataattttttgaaatgctaaacaaaattagtaagccactagcaagaaaagagagaagactcaaataaatacaaccagaaatataaaaacagacactacaactgatgccacggaaatacaaaagatcatcagagactattatgaagactattatgttcacaaaccagagaacttagaaaaaaatgaatatattcctgactacacaaaacctatggagattgaaccaggaagaaacagaactcctgaaccgaacaataatgactactgagattgaatcaataataaaaaatatctctcaataacaacagaaaaagccaaggactggatgaattcacagctgacttctaccaaacatccaaagaaaactaacaccaattttcctgaaacaatcccaaaaaaatgaggaagaggaaattctttctaactcattctatcaggccagtatcaccctgataccaaaaccatacaaggaaataacaacaacgaaaaagaaaactatacactaatatccctgatgaatatagatgttagtattttgcttaacaaaatactagcaaaaggccgggcacagtggctcacgcctgtaagcccagcactttgggaggctgaggcaggcagatcactaggtcaggagtttgagaccagcctggccagcatggtgaaaccctgtctctactaaaaatacaaaaaaattagctgggcatggtggcacacgcctataatcccagctattcgggaggctgaggcaggagaattgcttgaacccgggaggtggaggttgcagtgagccaagatcatgccactgcatgcactctagcctgggcaacagagcgagactccgtctcaaaaaaaaaaaaaaaaatactagcaagtcgaatccaacagcacatcagaaagatagtacaccatgacatcatcaggtggaatttatccctgtgatgtaatgaggattcaactatgcaaatcaataaacgtgatacatcacataaacagaattcaggaaaaaagccatacaataatctccatagatacagaaaaaaaagcattcaataaaattcaacatcctttgatgataaaaaaaatcctcaacagagtaatcattgaaaatacacacctcaacatagtaaaggccatgacccacagccattatcttactggggaaaaaaaagcatttcctctaagaactagaacaagacaaagacatcccctttcaacactcttattcaacatagcactggaagttctcaccaaagaagtcaggacacagaaaaattaaaagttatccaagctggaaaagaagaagtcaaattatccctgtttgctgatagtattgtcttatatctaaaaatccctaaagactctatcaagtttcaagataaaaaataagatgcagaaatcagtagcatttctatacaccaatctagctgagaaccaaattaagaaagcaatccatttacaatagccacaaaaataaaatatctaggaatatatttaacaaggaggtgaaagatctctataaaaataataacaaaacactgatgaaataaattgtagatgacataaatacacagagaaacatcccatgctcatgaattggataatcaatatgtttaaaaggattatattgcccaaagcaatctgcagattcaatccaatccctatccaattaccaacatcatttttcaaagcattagaaaaaaaatcctaaaattcatctgtaactagaacagaccccaaataaccaaagcaatctcaagcaaaatgaacgaagctagaaaatcacattatctgacttcaaattatagtacaaggcatagtaaccacaaaaccatggtattggtataaaaataggcaactagatcaatggaatagaatggagaacccagaaataaagccacatacctacaaccaaatgatctttgacaaagtcaacaaaagtacacactggtaaaatgatactccagttgtattagtccgttatcacactactataaagaaatacctgagactgggtaatttataaataaaagaggtttaattggcttatggtttcagaggctgtacaggaggcatggctggggaggtgtcaggaaacttataatcatgaagaggaaagaggcacgtcttcacattgctgggagcaggagaaagagagcaaaatgagaagtgttacacactttcaaacaaccagatctcatgagaactcactattgcaagaacagcaaggggaaaatctgcccccatgatacaatcacctcctaccaagcccctcctccaatactggggattacaattcaacatgaaatttgggtgggaacacaaatccaaatcatatcactggtcaataaatggtactgaaaaattggatagccatacacagaagaatgaaactggactcatatttctcgccacatattttttaaaaacctcaaaatggattaagacctgaaactataaaaatcctaaaagaaaacctagaaaacaccattttggaccttggccttgggaaagaatttgtgactaagtcctcagatccaattaaactaaagagctacacagcaaaagaaactatcaacagagtaaacagacaacctacagaatgggagaaaatattcacagattgtgcactcgacaaaggtcaaatatccagagaccataaggaacttaaataatgcaacaagcaaaaacaaataaccccattaaaaattgggcaaaagacataaacagacacttcttaaaagaagacataagagtgacccacaaacatatgaaaaaatgttcaacattactattcagcagagagatgcaaatcaaaaccacagtgagataccatctcacaccagtcagaatggctactattaaaaagtcaaaaaacaacagatgctggtgaggctgtggagaaaaaggaacacttatggaatgtaaatgagcacaacctttaaggaagacagtatgaaggtttttttttaaagaactaaaaacagaactaccattcaatccagcaatcccactattgggtataaacccaaagagaaaaaatcattaattacattaggtcggtcacggtggctcaagcctgtaatcccagcactttgggaggtctaggcaggtggatcactagaggccaggagtttgagaccagcctggccaacatggtgaaaccctgtctctactaaaagtacaaaaattagccaggcatggtggcaaatgcctatactcccagctactcaggaggttgaggtgggagaatcacttgaacccaggaggcggaggtcacagtgagccaagatcgcgccactgcactccagcctgggcaacagagtgagaccctatgtcaaaaaaaaaaaaaagaagaagaagaaaaaaagaaagataccagccctcatatgtttactgcaacaataataacatacgagtgctatttcataatagcaaaaatacggaattaacctgaatgtctatcaagagttgattgaataaagaaaatgtggtatacactcctacccctcccttctccccacccacccacagacacaccatggaatactactagggcataaaaaagaatgaaatcatgtcttttgcagcaacatggatagaactggaggcctttatcataagttaaataactcagaaacggaaagtcaaatatgacatgttctcacttgtaagtgggagctaaacaatcggtacacctgcacgtacagagtgcaatgacaaacactggagactacaaaaggtgggagaatggaagggtgggaagagtatgagggttgacaaagtactactgattgggtacaacgttcactattcaggtgatgggtataataaaagctcaaacttcactactacacaatgtatgcatgaaagagacctgcttataccccctaaatatataaaaataaaaatataaataaaggtaactgaaactattagctgattttttcttttccatatgtctaagtccttctttagaacatttaacaaatattcaccaaacacctacctactcagtgctaagcaaatgttttaggagctgaaaatgtagtagtaaacaagacagacaagacctttctctcatagaatttacattctagagaagagacaaataattaacaagtaaacaaacaaaatgattattttgtagagtaaaaaaatgaataaagataaaagtataatatgataaaaagttaacgaggatggggtgaaagcagcataaatttagcttaaaaatagggtagacagacttcttccactttagccttctttttcaaaagaagttttggccattatagttcctttgccgttcgtttaaattccagaaaaatcttgtctatacttataaaaatcatgccgaggttttgataggaattatattaaacctttatatcaattcgaggcatgtggacatctttattatcttgtgctatccaattcgtgaatacgtatatctttccttgtgattagatcttctttgatttctttcacgagtattttaaagttttactaaagctaaacgtggcccatgcatattttgtcagatttgcatctgagtatttcattactttttagggattgcaaatgatactgtattttttatatattttgtcagattcacatctgaatatttcattatttttcagaaattgcaaatgggattgtattttttatttcaaatgttcacatgttcattgctagtatataggaatacaattgatgttgtatatttttcttgtattctgagaccttgccaaacttactaattgcttctagaaatttattttgtagattccctgagattttctatgtaaaaaaatcatgtgatctgccaatgggtaagtcttatagtcttatttcttcctttcttatctgaatgccttcttccttttttgattttttttttccctgttattgcactggctaggacttcccacacgatgttgaataacagtgggcagagtgaatctgcttttcttgtctctgaccttttggagaaagtattcagtctttcaccataaatatgtcagctgtagctcttttattgatgttcttcgtcaagttgagtaagttctcttctattcttattttttttttgaaagttttaaaaatcattttcggtatggaattttgtcaaatgtttttcttgtatccattgatatgatgatgtgatttttcttcttctgcctgttattataatatactgatagattttcaaatagggaaccattcttgcatcactgtaataaaccccacttagttatgtgtatagttatcttttatgtattgttgaatcctatttgttaatattttgttaaggatttttacaactgtggtatatgcatgagggctattggtcttactttgtagttttctgtttttgaactatctttgtctgcttttagtatcaagataatgctaatgtcttaaaatgatttgggaagtattctctcttctttaattttctggaagattttttttgttttgttttatttatttatttatttattttttgggaattgacgtttattcttctttaaacatttggtatatttctccagtgaaactatccaggacagggatttggagctgaggggaggaggagtctaaagtgacaaaataaatttccttaatagttatagggctttcaaaattatctatttcatattggcgaattgtggtagtttgtgtttttaagaaattggtccatttcatctaattcatcaagtttatgtgtgtaaaattatttgtagcattcccttattatccttttgatttacacaaggtctgtggtgatatcacctgtttcagatagtggtaatttattttttctctcctctcttccttttcagtcttgcttgtgtttgtttagttttattgtcattttcaaataatcaattttttgtttcattaacttcgttgtttttctgttttctaccacattgatttccttccttcggcttcctttggatttattttgctctttttttttttttctaggttcttgaggtgggagcctagattattgatttgtaacttcctcttttctaatgtatgcatttagggctatacacatccttctcattgaatataaagacacagatatgttaaaagaaaaggatgaatcatgacttcagctgtgtcccccacacaacttgatacattgtatttttatttcatctagttcagtccattttttaatttcccttgagacttcttctttgacccattgattattcagaaatatgttgtttactttctaagtatttgaagatttttctgttatatctattatgggctgaagatttatgtccccacaaagatttgtatgttgaaatcctaacccacctgcaaagtgatgatattcgcagttgaagccttggggacgtgattaggtcacaagagttaagcccttataaatgtgattagtacctcacaagaagaggatgggagaccagagttccctccctctccaacacatgaggacacagaaagaaggcaagcaaggaaaagggaatttcaccaaaaaacgaattagccagcacctcaatcttagacttcagcctccagaactgttagaaataagtctgttgttcaaagcacccaatttatgttattttgctacagcagtccacagctgctgaaggcagctgttattgctctgttattgctttcttgtttgattctatcgtggtcagagaacacactccatacaatttgaatcttaaaatttgctgaggctttttttatggtccaggatatagtcttgtcttgatatgtgtcctgtaggcacttgaaaataatatatgttctatttttgttgggcataatgttctataaatgttaactagatcttttttgttgatggtgttattgagtccttctatattgttgctaaactcctgtctagttcttctatcggttttggaaaggggtattgaagtatccaaccatcattgtagaattgtctattttttctttcagttctgttagattttacctcacacattttgcagttctgttgtttgatgcataaacatttaggatttctatgtcttcatggtaaatgatattttataattatttggtgtccctctgtggtaattatttggaaggcctactttatctgttattaatatagctactctcacttttgtttgatttgcatgtgtctttttccatccatttactttcaatctgtctatatcattataagcaatgtgaatttcttgcagacagtatataattaggtcatgcttttaaacccactccactaatttatgccttttaattttggtatttaaactatttgcgactgggcacagtggcttatgcccgtaatcccagcacattgggaggctgaggcaggatggtcacttaaggccaggagtttgagactggcctgggcaacatagtgagatcctatcttttcaaaaaattgtaaaaattatccaagtattgtggtaagtgcctgtagtcccagctacttgggatgttgaggtgggaaggtcgcttgagcctaagaagtcgaggctgcagtgagctgtggttgtgctactatactccagacgacagagcaaaatgctgtttcacaaaaaataagaaaaaatttctaaaacagaaattatttacatttaatgtgacctgaacatttctggcattacattatattattatgtttcaactccaggtcttaattatattaatgaagaccaattctgatttttttcttgcccaaattactatctgaggggtctggggagtcatgccctacaaatcataaattctcatcagatgggtttatttaatcctatacattgtgacttactttccaatctggctctggcataacatgagacaaggaagaaaaggcaaaatactttatcccaaaacacgtttcttgacatattttgaaatggccctgcaaagctgttctttgtagggaaaattttgcatctgtaaagaatgtctattaacatagctacatctttttctttcagaccctcccaatcctaaagagattaactaaaatctgaataggaaacatttgttgtctatagtctctaagggcagccactaaaagacgtcaaaggaactttggtctccacaatctttatcttaaccagaacatccctatatccctatagtctggaaccaacaacccgctgcccccaaaagcatttgtaaaatgtataaaacaaagctgctccctgaccaccttgggtacatgttttcaggaccttctgagggctgtgtcacaggccgtggtcactcatatttggctcagaataaatcttttcaaatattttacagagtttggctcttctcattgacatgtatttatttattttagagagaggttctctctccgtcacccaggttggagtacagtggcacaatcatagctcactatagcctcaaactcctgggcttaagcaatcctctagcctcagcctcctgaatagctgggattacaggtgtgagccactgcacccagatagaccttcaaaccttctattttctctggcttctactgacactcatccagcaggggaaggtagtggccttgttactgacaagggaatgaagaagtcccagttccccatgtggccttctctgataccccaaaggcccctcttttcagctggatgaggtaggaattcacctccccactaggacttcacggatctcttcctggatgggagtggtaggtatgtctagtcactgttccccccttaatctccactaacaccacactgagtggaaggtggccccatgaatgctggtccgtggtgaatgtcctggctttctactagttcttccctgacaacaacccagcaggaagggggaaggtgcttcaatgtcatggattaggggtggaaggccatgctcttcactgatgctgaataggccaggggatgggggtgctcactatctatcattgagattaaagtcctggctccccacgccattcaaccgttgctcccatggggaggggtgtgttcattttaatttttttcattttctgtggtgtttggctggagtagagcacttattgtctagcatttttctgtcttgctaggttgtccttttcccggtattttggctagggagagcagttttgttttgttttgttttgttttgttttgttttgttttccttcacatgtacctactggcatttctgagctgcaggctcctttagctccaagaataggacacatgaggcaaagagagaatccagggaactgaccaccatgtctttccttgggtcccaaaggcttcagctggtctgcaatgctccacctttcagtcttatgcttgttttatataggacatccagggtttttggttgtatttagccagaaaaatagagaaaatgtgtctactcctccaaagcctgtttttgcacagccctagagctaagaatggcttttacattttttttttaaaagaacatgagacaaaaaaagaccacatgtgacctggaaagcctaaaatatttactatataatccttcatacaaaaaagttgaagacccgtgacttcagccatgttaaggcacctggagtttattctaagtgcaactggaaggcataggagggttgttggcagaggaataaagtgattttgtttgctactttgaagagattactgaagttagtgaatccagttatctctaagcaatttcctagagtccacaaaaggagtctggggaagcaggctctgtgcatctgggcaggggcttgagaaagggagtgagtcagcctaataaggactctagcatgtggaggcgtgcctctttgctgaggttttatagtaagtaggtgagaaagcggggagtctaacccaggtcagtgcagctccagagactcatatccctcattctgctctatttcaggggaggactcataggaagactctgagcccaagtctctgagccttgagattttgaagacctagcggggagggagaggaagatgcctggaggattcccataggttcctcccacaggctagccctgctgggctcccccgagcttcttcctccatactgtgaacctgctctttgctgcttcctagctcgacttttcatcatcaccaagccatttgtttctgtttgtaattatgcattttaatgttcattaattatggaatgcaaattgctctgagtacaaaatttgtaatgagctgttttaccaccccacccccaggtctagaaggtgggccagctgttctgagcagaaggaaaaacaaccaacttacaaaacagaacaatttgtcctagggcctgagtgaatcatatggtaaataagcctgggggacttcctgctgatgctggaggtggggccctgccccacctgggtcctgggtgacatcagtgtggcaatttcattctttgctacaaacttgggcctgaaaggcaggtggggtaaaggaacagcactagtcttagaaccagccttttactggctatgacaccttgagctagtcccttggcttgtctgagcctcagtttgtccttctggaaggtaaggattatgatgaaattatcctcaaagtaggggtggcaggcaaacactagcaggccctggataaatgcatgtgaatggctctccagattgctggattccagttctgcctggctgtgtttttttttgttttgttttgttttttgagacagagtcacgctctgtcacccaggctggagtgcagtggtgcaatctcggctcactacaagctctgcctcccaggttcacgcgattctcctgcccaagcctcctgagtagctgggattacaggcatgcaccaacacgcctggctaattctgtatttttagtagaggcgggggtttctccatgttggtcaggctggtctcgaattcctgacctcaggtgatccgcccgcctcagcactcccaaagtactgggattacagctgtgaggcaccgcacccagccaaaaatttccagttgctttcttttctttttgagatagagtttcactcttgttgcccagactggagtgcaatggcacgatctcgactcactgcaacctctgcctcctgggttcaagcaattctcctgtctcagcctcccaagtagctggaattacaggcgtgtgctaccatgcccagcaattttttttttttttttttcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggatgcctccaaacctgcttgactatgaacaatgacttgttctcctccaaggactaggtaagtatttgatttctttaagtctcatggccagagaaagcataataacagtatcacctcctactaatagtactcctctcaacaatagtatgcctcaaaaattatggtaaatattttttatttattgttattattttttacagacaaggtcttactctgtcacccaggctggagtgcaggcagtggtgcaatcatagctcactgcagtcttgaaatcctgggctcaagggatcctcttgcctcagcctctcgaatagctgggactacaggcatgtgccatcatgctcggctaattttatttttatttttattttttttaaaacaacagctttattgaagtataatctacatatcataaaatttactcatttaagtatatgattcagttattttaaatttgcagaattgtgcaaccagcaccgtgatccaatatttaagtttccatcatccccaaagatcgttcatgtactccttttgagacagagtctcgctctgtcacccaggatggagtgcagtggcacgatcttggctcactgcaacctctgcctcccaggtttaagcgattcttatgcgttggcctcccgagttgctggaattacagttgctggaattacagccccgtgtgtgccacaccggtctaatttttgtatatatatatttttttcctgagagggagtctcgctctgtcgcccaagctggactgcagtggcgtgatctcggcatactgcaacctccacctcctgggatcaagcaattctccttcctcagcctcctgagtagccgggaccacaggtgcccgccaccacacccagctgatttttttattttattttatttcattattattattattattattatttttttttttttaattgatcattcttgggtgtttctcgcagagggggatttggcagggtcacaggacaatagtggagggaaggtcagcagataaacaagtgaacaaaggtctctggttttcctaggcagaggaccctgcagccttccacagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaacaatttttcttagtacagaacaaaatgaaaagtctcccatgtctacctctttctacacagacacggcaaccatccgatttctcaatcttttcctcacctttcccccctttctattccacaaagccgcgattgtcatcctggcctgttctcaatgagctgttgggtacacctcccagacggggtggtggccaggcagaggggctcctcacttcccagtaggcgcggccgggcagaggcgcccctcacctcccggacggggcggctggccggacggggggctgaccccccccacctccctcctggacggggcggctggccgggtggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcgtccgggcagagacgctcctcacatcccggacggggcggcagggcagaggtgctccccacatctcagacgatgggcggcagggcagagacgctcctcacttcccagatgtgatggtggccgggaagaggcgctcctcacttcctagatgggatggcggccgggtagagacgctcctcactttccagactgggcagccaggcagaggggctcctcacatcccagacgataggcggccaggcggagaagctcctcacttcccagacggggtggcggccgggcagaggctgcaatctcggcactttgggaggccaaggcaggctgctgggaggtggaggttgcacgagccaagatcacgccactgcactccagcctgggcaccattgagcactgaatgaacgagactccgtctgcaatcccggcacctcgggaggccgaggctgtcggatcactcgcggttaggagctggagaccagcccggccaacacagcgaatcccagtctccaccaagaaaatacgaaaaccagtcaggcgtggcggcgtgcacctgcaatcgcaggcactcggcaagctgaggcaggagaatcaggcagggaggttgcagtgagccgagatggcagcagtaccgtccagcttcggctcggcatgagagggagaccgtggaaagagagggagagggagagggagaggagactgactctaattttatttttattttttgtagatatggagtcttatgctgaccaggctggtcttgaactcctgacctccagtgatcctccatctcagcctcccaaagccctggaattacaggtatgagccaccatgcccagcagtagtaaagatgaaatgagaggtgaaaataacgagactaaacacataatgaaagccagaatacactgtcagtcacaaagaatagacacaactgtgaatgaagtctgactgagccacttcctcaatgtgtgccctggctgttctgagtctcagtttccacaatttatacattggagaaaataactccttcctcactaggcttgtgagaggatcccaggaggtcatttacctgatatgtgcctgatgcctgacaggtgctcactaaatgctaactgctattgtagttaccttgttactttctccaaataggacacattcagggagaaatgtaagggaaccatatacagggaaatggttaggcatttcttccatgcctacttttccaatgaggaaactaaaactcagaggtcaggtgagctgccttgggtcatacagcaagcaagagtctgactgagcccaccactgaaggccccctgactatggggccaaatgaggttctcttttccctgaaccacatggaggtggcttgtctgtggtgttacaagtggttcagactggctagtgtaacacagagattctgagaaccttgtgggaagggccctgtaatgagttatcggaggactttggtgctttagggacagagaggttgcttgtggcatagtcttggatgtacagattaggtacagcatcttgggaagaagagatagggaaagatgcaaggaaggaaatgaaatgcatatttattatgcacctaccataagctggatgtttcccaatatgctatcttttttaatccccacaaaactcagaggacctctaagatacaatatactcattttacaggcaaggttattgaagatcacacaggctgaagaagggctgctgaattcttcaatatgaaccatccctttgataagaaactgagtgggcctggttcttctcatcccaggagagctctggtgtgcttcctggcatataagtgagtgggaaaggctctgccagtccccagtcccccacccctcttgccactcagcctcaatctgtcaaccaggccagctagcccgtctattaatgctgacattgatttggatcaatcaagatcccataattactgggagttttaatcaactcatgccaattcagctgccgctcaatttgtgctggacttcggtgctcacaaggagggaagcggcgagggtggggtggggcggggggagggcatgcaaaaaggattacagggatcaatagtccttggtaatgaaggacagcagctgcaggcaccaccagggggcctgagacttcagagtggaggagacagagcctgcccccatcccccaggagagctccctggcagagaatgaaaaccacgcccctgcttcacctctgcctacacctggatctggaaaccacttaggcactaccaggcagcacctgttctctgcagggtccaaccctcagtatctctctccacattttgccctcagccaggcctggcctcctcttcctgaagaatcttatgtatccttcagagccagcaatcccattactgggtatacatccaaaagaaaataaatcgttctaccaaaaagacacacgcaaccgtgtgttcattgttgccctattcacaatagcaaagacatggactcaacctgtgcccatcaactggtggattggatttaaaaaaatgtggtgtgtatacacttgaaatactatgcagccataaaaaaatcatgtcctttgcagcaatatggatgcagctggaggccattatcctaagctaattaacacaggaagagaaaactaaataccgcatgttctcacttataagtgggagctaggacgggcgtggtggctcatgcctgtaatcccagtgctttgggaggccaaggtggatagatcacctcaggtcaggagtttgagatcagcctggccaacatggtgaaaccccatctctactaaaaatacaacaaattagccaggggtggtggcgggcacctgtaatctcaggtactcgggagggtgatgggggagaattgcttgaactcgggaggcagatgttgcagtgagccaagatcgtaccattgcattccagcctgggcaacatgagcaaaactctgtctcaaaaaaaaaaaaaaaaagtgggagctatatattgggtacttatggacattaaaatggcaataatagacactggggactaccagatgggggaaggaggcagggaggtgaaagggaagaaacaggtgcaaggattaaaaaactacttattgggcactacgcttagtacctgagtgatgggatcaattgtactgcaaacctcagaatcacacaatatatccaggtaacaaacctgcacatgtaccctctgaagctaaaataaatgttgaaattattttttaatcaaattttaaaaaactctgtaaattatttctcagcagtctctgtggttatgttcctgagttcaaaaagcagaagaatgctgaggagacaaaaaaataaaaataagattaatccagatactgtcatttcctagctgtgtgacttcaggcaagtcactgcacttttctggtcctgtttttcctgttctaaaatagactcaataataaataaccgcctcctgggattgctgggaacattgagtgctgtcacgaatgaaaaatccttgtgtggaagttccttcttccttttgatgtcccacatcagaaagaatcagttttctttttctcccatgttcattattcttctcctagcacaagctttattctgccaggtgggacggtttctgggtcacagtctgtttccctacgagtccacagctatttggggacagggactgtaatacacacagcttccttttctcagtccagcacgtgggagggagacaagccagtatgcaaggcaaatgtggcctttggggtcaagcaagcttgggcttgaatcccacctgtctttgccacttactaaccatgtaatgttagccagtcacttcgttaacatttgaacctcaacttcctcaaagtaaaatgagcctaattacacctactcagaattgctacggaggaaaaaaaaaaaaacaaaaagttagacatttaatgtccctaacatagtatctagcacaatggtaagatcctgattgttataaaagttgctattatgattattatcactcttaatattcagtgctcagtaaatatttttggaatgtaataaaatgtctggttgtattgcttagttttggcttgagttccaatgaaataccaacaggccattatccccacatgccagccatctgtgcagccttcaacacacacttactgaagacaccagaaaggaaattcaaatgctttcaggacacactgtgggccaggcactataggaagtgttttccttatactgctttgctgaaggcccacacttctatgagattgctgttattgctgttattagcttgatgtctgcagaagagaaaactgaggctttgtggctggatatgtctttccttgtagttctagcagaaccagggtgcaaacatgggggcgtttgactccaggcccctgctctctccactgtaccataccattctttcttttttttgagacggagtctcactgtgttgcccaggctggagtgtggtggtgcgatctcggctcaatgcaagctccacctcccgggttcacgccattctcccgcctcagcctcccgagtagctgggactacaggcgcctgccaccatgcctggctaattttgtttctcttatttttagtagagacggggtttcaccgtgttaaccaggatggtctcggtctcctgacctcgtgatccgcccgcctcggcctcccaaacgtaccattcctttcttgtggaggcaccaagaagtagaaaatgtgagagttcccgacttcaggaagaatctagaccaatggtagagatcaggtaaattcccagagggagaaaagtcatagttcaaaatggcttatgataaaaaatgtgccaaacaacaaaaaacaacctgattaaaacatgggcaaaagacttgaatagacatttctctaaaaatgatatacaaacagccaattggcacatgaaaagatgaccaaaatgattagtgaatcattagcgaaatgcaaatcgaaactacctcaccctcattaggatggctgttaccaaaaattcagaaaataatgagtgttggtgaagatgtggagaaattggagcccttgcacactcttgataggattgtaaaatggtgcagctgctatgaaaaacagtatggaggttcctcaagaaattaaaaatagaactaccatatgatctagcaattgcacttctggatatatatccaaaagccctgaaaataaaatcctaaagagatatttatacacccttattcatagcattgtcattcataatagcctaaaaggtaggaacaaccaatgttcattgacagatacatatacacacacaatggaatattattcagccttagaaaggaaggcaattctgacacacgctgcagcatggatgaaccctgaggacattatgctaagtgaaataagccagtcacaaaaagacaaatactatatgactctatttatatgaggtgcttatagcagtcaaattcacagagatggaaagcagaatggtggttgccaggggctgggggaagggagaatgaggaattatttaatgggtatagagtttcagttttgagagataagtgctgtagattgggtgtacaacaatgtgaatttgcatcacgctaccaaactgttcacttcaaatgcttaaggagataaattttatgttatgcatatcttatcacaattaaaacaattttaaaaatgtattttaataaaagggaagcagagagtgaaaggcataatggttcctaacttcaaagaaaatctagaccaactggagggaccggatcaaccccaagagagagataagccatgtttcaggatggtttctgatcaagagcagtgctgcaatgacagcatgctactgcgtggctgggtttgctcacacacactgatcacagctaattatctgaatatatgctggctacttttcccattagaggagtcccacgtaattaggggacacaggttaccatccttgctttgggcacatccctgcccttctctggccgtcaatcttcctaactgtccagtgagaaaagtggtagctggtccgtaaggggtctcccatcttggacattctatggttctctgccagtggtcaataggaattccaagggaggtaggttctcgcagtaggcagcacctgctctagtgcaagtggcttgggaacatgcttgaagctttcccctacagcctcttaaaatggctggtcaaccttttggtggcagtcgcgaagccttctgcacacagcaagggttcagttcaacaaatgcctattcagaacctgctgtcttccaggaattataaagccttagcttcattctcaaaaaaaaaaaaaaaaaaacaaaaaacaaaaaacaaaaaacaaaaaaaaacatatattctaatggggggagaaaagtaagtaagcacattcttatagttctcaaggttttgttttgttttgttttttgagatggagtcttgctctgtcaccagactggagtgcagtggcacaatctcggctcactgcaacctctgcctccctggttcaagtgattctcctgcctcagcctcccaagtagctgggactacaggcacacaccaccatgcccagctaatttttgtatttttagtagagacggcgtttcactatgttggccaggatggtctcaatctcttgaccttgtgatctacccgcctttgcctcccaaagtgctgggattacaggcatgagccaccgtgcccagctgaggatttttataagcaccaagggctgaggcaagggaggccagggaacactttcctaggaaaatctgccaagactcctgaggaatgtctattcaatacctatctggtgatgataataaatagcctttgtgtagctcattaataataataatagctaacacttaatggcacttatcatgtgccaggcactgtttcgatgtgttttgaatattaactcattatgtgcacagcctgatggtataggaactactagtctactcattttacagagagggaaactatggcacagacagctttaggaacttgtcccaaggaaacaaggcaagtgagtggcacagccaggatctgaagccacactacgctgccttttacaatgtgttaagctttctaagttacttcctcatctgttatatttttctagcctcatggagagaggtgctgacgccatttggaagaataatatcctgaggtgcagagatgtaagagaacttcccaagatcatacagtgattagatgtggggcgggacagaggctccactcaggtctgcactgctacaaagctgtaccctctgggctgatggcatggctcagtgaaggagctctctctgttcccaaggcagaggctctaactgtcttcacctgggttcaaggcgctgggaggaaaatgaacatctgttgtgtaccccccatacaccagacacactgctaggctatgctaatttatgaaatcttcccaacaacccagaaaagaatgcaccattattttcaccactcacagatggaaaacaggcttggagagggaagatgacttgcttcaggtcctcaccatagatgcttggatgtctttctgttttcagaagcctcatgtcctattacttctctgagtagcacagagccgagggaattttgctacagatcaagtgcagggaggtatttggggaaaatagcttattgtgacattgcctgagcacttgactatgaaaccaggtctcctcctaagagcattgaatgtgcattaactcattccctcctcaaagcaaacctatgtggcaaacaccaaacaccaatatcatgcccacttaacagatggagaatctgaagcgcagcacgaagaggtgtattaacttgatgaaggtcacacggccagtaagtggtggagccaggaagcctggcacctgagtctcttttcttagcccttccgcaatacttcctcatacaacaaccatgtaaggtagtgtgacataggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaagacacttatcactttaatgataacaagaattttagaagttatatgcccagaaacagggataaacaccaatatatattaatttgcaggtactattatttcaccctttttttgaatactgggagattaagacttaaagaggtttaaagcaacttgtctcattacagaggaagggatcgagacaggatttgaacctgtacagcttgataccaaataacttgtgcctagcagtgagttacttattcaggggtcagggccaggccttcattagggcaggctggacatacggacttttccatgctgctaggtttaacaggctggtatcgcttccccatctcttgtcactaaaaactcaattagcagcttgaggctgtgtcctcacatcacaccttctcattgatcactcagactgtgagtgagaaagattttaaagctggttggctttgcaaagcatagagcagcaaccattgagcatatgcttctgtgggtatatatttattcagcttatgttgagtataattttggatggtatgcatattttattttttgttgcagagagcaatttaaaagaagaaaaaaaatccttctctgaatggagacagatgccatatatgttggaccctcaggggattgaaaaggatgaggttcccaagtccagtgttctggggacggacgtgggtggaaggaaactcacaagtgatgggaatccaggatcaactgcaacacccacagcaaggccagcaaggcactaaccacccagtccagggcagggcccttcaaggttttattcccaaggcctccccagtagcctgtctgactgttctctacatgctatttactgagtactaaatattgagtgatgggtgaagtgcacatcatcccccttaactttccccacaactccatgttgagatgctgttgtacatatgagaacacagatactacattgcccaatgtcatcaactagaacagcaggaatctgtgtgctgggaagccagaccccagaaccagtgctctcaaatccccaccaatgtcatctagtggttactggagtccttattttggagtcctgatatccatgctaccaattcctatctgagtgacaatgaacatgtcacttccctttctgagttggcttccacactcacaggatggagactgagataccattttgctagggtgttatcaagattcagagatccaaagttacacttaaaagtcatttgagacatttgttctttttttctaccccaccccctgcctaaaaggttctcctcttacccaggatgaactcaagatgtaacattttaaaatgagccttaggaaaaaacctgcaagggttggtaccagctggagaaaaataaatacgctcatgtgggtgccaaagattcaaaagagagaagcagcagcccaaaccagagtctacaccagagggaatcattatggaaggagaaagttcatcctatcattgtgcagaaaggaaggatccatgtgtgactctagggagtaggatccaaagcatcattttctagctctgtaaatagactatggactctttgctagttaggacacagtatctttctaatgttagggcccagaagagggtcttacacagcagtacttagttgttgagctctgaatgcagctaaaattcaactgtgggttgtctaataaccagtttttgcttcaaccaaaggcaagtttgatctagtttgataagatgtgctagatgctggagaatccattaccaacagtcaagaatcacataaaagagctgctctatgcatacctaagtgggaaaactgtaaaaaaaacatgattagcataaaagacagggtcttggccacttccagaagggaggacagggttacaattggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgttttagttgaattgcttcattacctaaataaggcaacaacaaaaacgtgaaggtcagttccaccacttctgcctgaaattcctccaatggagaacctcatcttctccctaaggttcaatgtgcatgaaagaacagctctgcagagtaagttgaggggtgccaaatcccactggctcttatataggcctatctgcagtgtcttccccctctggaaccaagtacatctttgacttaggtactgtggcgggaaagggagatgccccagagagaatcaagtttaactctgaatttgtaggaaggacaggagcatagctgaggattcacagtaaacagagtcatgttgagaaacagggtcccttcatcacctcggactgtattatccccatgatcatgggcctgaaaaatcacctttccctttcagtgatgatgaagaaaatttctgaaaaccaaggaaagccagaaaaggctactaagtttcctagctcaacaagctcctctctacacaataggacctgatcttaggaagggaggccatggccctgggttttgctcatgcctggctactttcactgggtccggccaacaatattgtaaggtgcagggatcattcccattttatggatcagattagaggggctcagatacattcagcaatttgtccaaagtcacacagcttcccagttacagggatgggatttgaatccaactctgaattatggacaagtctattctttttactggactggaattctgattaactagcccatctctctctaggaacgtctgtcactcagttcgggtagaattttctcaatgaggagaaaggctattgagtgtttgatgaaaccttctcactgtttgctccctcaagggaaagggatttcaaaatacctgggctagtgggtcaagacttcttaaagcagggatcagagagaagctggagaatacaggcaaaaggatacctttattatttgtaaaatttaataacaataataataatgtcatttgtcatccatttatcctcaagacctatgataaaagacaaaagaatgatgataaaaataaaagcatgttatcctgggtggaagagagtcctacactggaatttcagacacctgggttctatccaagcatagctcttgtgctctttagcctcaatttgatcatctttatttattacccaaggggaaaatacacacacacacacacacacacacacacacacacacacacggttaagatcaagctaggaagtcagttgtcctaaaaagaaaaaaaaattggaaaagctctaggaaaagcagaatgtgtagttctgacttagaaaattgtcccgaagaaacacaactgtatgctttttatgcttccatttttaaaattacatatataaattcttatttatatttgcatatgcatagggaagaagtgtatggaaggatatgtatctatctatatatacaccaaaccgtggcacatttatctaaagtgggtgagtagttaagaaagggggccttgagtttttttctttatacatttcaacactgtacaaatttattttattttataatgagaatgagctacttttagaaaaccaaaaaaaatttttaaaggaagattgatgatcagatggagaaaataccttatgaatgcaaaaattctattattataattaagatgaacacaattattccagcttttcgtttcagagctaaggagaaggtgtctgatgatcagcattctgatgcctcaggagacactcactggtgcttggcacaaccactaaaagttctgtagtcatggcttctgacctcctcaaaccctcaaggagacagcagacccacggcctcatttactctcctctgcattgcctcttgtatctggaccctctctcacagacacagtgcacacctcactggactccactcccacatgtactacatttattttatcactctcctgatcagagaccctttaggccaaataccctagcccgcccttgggctgcactctgaaagaaaagcagcacctaaaacagtgtggagcaccagatgctctattgctccttttgaaaaaatccatcccacaccttcacccaaatcatgaaacactaatacaatttgaaaactgtccttacagacttctgggaatctcttctaaagaaacagctcaaaacacagaaggtggcttctgcccaaaggtgctcagagcagcacggtttataatagactaaatctggaagcaatcaacatgtccaaccagaagacaaagcaaatgctgggatgttccccttcatgaaatattaggcaatattagtgatatatatgaatttgtcctggttaagggttttgttatcaacctgctttggcccaatttggcccgaattccctgctctagaactgagtagctttgtggtcctgagcaaattacctaagttttctctggctcagttttcccatctgtaagaaaagggataataatgagatccacctcagaagccttgaatcatagcaagcattcaaacaattttagctctcatcattgccaccaccaccatactcaaccctgcatgagatatcagataataataatagcaaccatgttttgtgcctgcttagggccatgttctagcccattgcgtatgcattctcagttagtcctaacagcagctttggcaggcataagtagtattatccccattttactcaacaggaacccaaggctaagaggctttaagtaacttttcccaaagtcacatggctagtgaatgacaaggtaagattttggcccaggtttctctgatgctaaaaactgtgtacttaagcactatagtgtcttcccaaaagtaggggatggtagtgggagatggtagtgggagcagtgatttatgcagggcttgcagacaacagttgggaaaactaggagtgcagcttccatttcctgcctccaatttggggcttccttctctctttttttttttttttttttgagacaagtctccctctgtcccccaggctggagtgcagtggcaccatcttggctcactgcaagctccgcctcccgggttcacgccattctcctgcctcagcctcctgagtagctgggactataggagcctgccaccacgctctgctaatttttttgtatttttagtagagacagggtttcaccatgttggccaggatggtctcgaactcctgaccttgtgatccgcctacctcggcctcccaaagtgctaggattacaggtttgagccaccgcgcccggcctcccttctcattattccccccccaccattatttcaggaatcaaagggtaaaacccatcactttggaaaaaggggggctgcttcctgactttaacagataatgacttccacacaataaaaccagcttaccagaaataccatcagacccagcaaatccaagtcccaacgaaataaaataaggggaaaaatagagaaggcttcaaatgtcatgagaagaaaaaaatatttaatgtcataaaagggtgcataggctttatgagaatgccacacacaataatcttggaaaccctattaccccacctacccacccagcctgctccaaattcataaaggaaagatgcaaatgcactgattggaaagatgcaaatgctcctgattgaggagctactccctccttttcatttcccaaactttgagtcctgtgtgcaggcattgaatcagtggacacagtacagttccaattcccttctttactggctattcttatgtccttttccaatacagttccaatttccttctttactgactattcctatgtccttttccaatacttagcctctttagcttcctctggatctcttggatgcagtggaggagaaataaatactggacattgatagagggtaaagagaagaaagtgcccctctcttcatgcttcctgacattggggacattcgccttatccctagggaactattctcagccttgggagggtgtcttctgatgaattaagagaatgagctttggagtttgacagagtttggagtttcctctgcctttacctggctggttggatttgggcaagtttctcatactttctgactctatttcctcatggataaaatgggagtaataataatgctttccttataaggtagctgtgaggatttccagggccaggcacataattagtactgaaatgttctctctatatatccgtatcagtaatactaggcctgatattatttatagcatttattcatttattttttagtagctttaataatattaggcctagtattactgatcaaggtattcaatacatatagagaattctctgtctgtgaacctatttgactagaggatactttgatgaagacaccatgggggcgatatgtcatcctgtaaatcctgttttgcaacccaagagcctgaagttattcccataaagacacctgcctgctgcctttgcatctttctaataatttttaaaaagaaaaatagggcaaccatcagtcctctcattttggattttggcaaaatctgtctcagttgtcttctgaatctatcataccccatgtggctgatctacagggataaatttagctttgaaagtccatttctggaaaggaaaaacaagtctccaagggctagatcccatggaggctcagcccagctgcaccgtgtaggagggttacatgcccaggcaggcagggctgggctttccctggtcagcagtgcctgggctgtgctccaaggtgatttctcactctgctgactcttcttgctagtcttccccacccctcttgagttttgttcctttaattacactgcaattgagtcattaagagggggaaaggatgaggaatggagaaaagccggtctctctcccctactgaaccagattccagcttttgcctccctctgagcagtgctataaggttcctggcctatactaaatggaaatccatatgtttattcatcttgacttttagaaaggcagctcttgttgttgtctctcagcacctgtgcaatcagggatcctatgatctttcctaatatctggcaggccagatggttttttagatcaaaatgaaaaaagaaaaagatggggcagaggcggcagaaatgtgactgggtgatttgtagggttgaggagtgtgggattggtttgagattgttctagaattcagagccagggctaagaactgaccacagaggctcctcctgaaagacaccatcactctaagacccagcgagtatgcaaatccttccacttcccttagtcctttctatgaaggccttgactattcgatgttgcccctcctttctatcctttcccattatttttctccacatatcccagtttcctaccagatagtttcatttttctcatgtgtgaagtgaaggtaataataatatctggctcatattattactgtgagcataaggttggttaaaagaagcaaagcacttagaaccgtgcttggaacagtctttgtatggatagttgcttttatattactagcttttcttttttgtaaaatggacatgatagttccgggtaggtgataattataggcattaattgccatgaacataggcaaaataacacatagtaggtgcccagtgagtgccagttctctcgtatgaccactcttttctctgcaatattcacaccaatcctcttagagaattttcacacagagaaacaaagtggtttgttcaagattatgctgcaatcctgctgaagtctgtcttgtcttctgaaggggcttataaaacaaggcttaactcttgtggtgttttgctcctggtccattcacagtgctggatacaggaatgttgcgaaataaataattatactatatagtgacaaagctgatgctatggggccattaggtgttggaatgtgaaactggaagggagtcttggaattaaatctaggttgtattactacctccctacatgaacttgagcaatttccgtatctttctaggcctttgtttttctgtttgtataatgggagagggtcctttctggctctggtagcccttgtctgtctccatgcaatgggtaaatgggtagattaaagatgatcacacattctttgctactcttcgcattgacaggtgaaatctagctctttcccccttgaatctgggctgaccttattgacctgcttgaccaatagaatgtggtagaaatgatgttctgagacttctgaggctggggactaagaagccttgcagcttctgcctaggcacttagaacgctggatcttgggatggtcccttggtaagcccaggttccatgatgtgagaagcccaagccaaatggggagcccaagaaaaaatcctctatccagttgacagccccagctcaggtccagcatagccagtgtcaaccaccaatggtgccagtcctagccccagacaggtaataaaggaacccttctgcaaatgactccccagtcccagatgccccatctgtctttgatcagagacaaaccagctgcaccctccacatagtcctgattcacaaatctatagacaaaacaagagtgtgtgaagctactgagttttggggtagtttgttataaaacaatagaaagctggaaccaggaaagtgagctatgaactgatacttcaaaaagggttaaggaggacgcattgtgtttaccagattgtctggtgttgggttaatcaaaaggcttcctgtgctgggaaaaccagaaaaacataaaagaatggcattagtgaagtgcgtcagggggcagcagttacttagagatggtggtggaagtgtcctccatacgatgctgtgattaagtgcttacagttttctttgtttttattctctatcttgattaaaattttgcagtgtttatactgccacacagaataaatggacccatagcttacatttcaaactgtgccttgctgacatcattatgtttgtcagatttataacatttctaatatacaacaatttttcactcttggaacactgaaggggaacacaggctccctctcttttctgatgtttcattcactgttacttcctctatcactggtcaagggatatggtctccttggaaataactgaaaacaaaaataatagcataattatttatatattatttactgtatcaccctcctcatatgatcttttacctgttatcagtattttattgctattgtagcaaattactatgcaattggtggtttaaagtaacgcaaatttattatctcacagttctacaatttaaaagtctaacttgggtctcaatgggctaaaatttaggtgttggcagggttgcattcctttctggaggttccagaggtaagtctttctctttgcttttccagcttctaaacaccacttctcttccttagcatgtaactctcttcctccaacttcacagctggcaacgctgcctctctctaccccactcctctgctttcctgagcacactctgataattcaagatattctcgctcttttaaggtcagctaattagtcatcttaattccttacgcaaatttaaatcctggttctgtcatgaaaggtaacataccagtcacaggttctgggaattaggatgtggacatctttgcaggggccattattttgcctactacacatcttatggccatcctccaattggccaattacctatatgagaaacatattatccaaagggaaggttaccacagcagaaccagaaagctgagcaaaaatatgtcagattttttaaatcttgtgtttcaaaagttgaggtctagaaggtagagctattttagaaggtaaaataataatcatcattataatgacaataataaagcaatagaagcatctgtgatctgttagagaattaccttcccttgtatccacaaagaagtaaaggtcatctgagctggtggaagacaggaatgttggaagtcaaacaaagtaatctagaaaatgctaatgagtgttctaaaaggggtcccatcctctatccttaccaggctacgcccatgagtgtatgaaggggatgagggggtgcagaatatcaggtgggtttgagggctatgaaggcaaaggggttctgggcgtcacttgctatatagcacaggttgacagcaagcatggtgagtgatcctccccactgtgaaaacagccaactacagatcctttcctggcatgtctagatcaaaagagctctagacagctttcctcagatcctccaggtggaactgttggacatttctcaggccctctggaggctggaaaaactagctgacgcacagagccagctggccttaaatgaccttgtggtggaataaagtggatgaggcagcagctgtactacacacctgtgagtcaggtgggaatggagaggaaggagagtgatggacaagggccaagtgatgcagcaggtaccagattaaaaagtgatggcccagcatcaaacatgcccttagctcctaggccttacaggtacattggccctttgagctaaaatgttcagttaagaggtgggaggcagaaaaaaaactgaaattgactagagttaagtttccactaacaatggaacagaaatgaaatgaaattcagttacagaaacgtaatagaacattagatacgctgtgctcctaaatttgtgtggccccaaatatatccactacatacaaatatcagtaatgtggtctccttatctcactcataaatggtactttgtaaatcccaaatcattgccagttatattctttgagctctttcagttttttgtttttgtttttagaaaaatctgtaagtactgttgcttccttttgaaagattaagaaactgatgctaatgaagtcaacatagactccaaagctatggtcattctaatgcctaaatccaggctttagcccaattcactcagcccagcctcctttccatgattcttcaacgagaactcatctcagctcccagtgtgggaaagcaagccaaagtggccctggcagaaggactgatagtgagacatggtcttggtcctccaccctgccacctggtggtaagaccttggaaagtcactctgcttcctgagcctgtttccacattcctgagggaatctactgcccaggtttgttgtgaggatgagctcttagcttgtagacatgctttgagaatgctaaagtattctaaaaatataaggaattatcatgtaatacctgaaggaatgtcttagaaggtgagctatgagaagaagtttctctttacagacatgatggagagtctacagagaaatgaaagggatttaaaatctcagcataaacgtggtatttccctgtctattctgaagcacagagaggagcttgccttacatccattgaaccttgaagtagtggttttaaaattacatcctcaatctagagaggagggtctttgacaacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaagagaaggagcttaattaatttgagaaaagagaactaatggaaaagaggaaagaggcagacaacttaatcctttgaaaaaggtcagccttacattctggacacaacacagaacatccttttgagctgtttgtccactggctgggtttcagacttcagcaaatcctcctctccccaactagcacttttccaatgtgctatatgaagggttaggtttcaatggtctgaggcagacagctgttgatgtatatcaatctagcatctacaactcctgttgccagcaccccagtttttcttgagagtctatgccttcccccatctcagggccatgcatttcaggtgtagctgcctcctggtgcaagctccaagcatggctgtctctgggatgagcccagttaatccccctgaccagcaattggtgcagggataaatgggcatgagaaccaagttggcacaatgagaaggaatctggtgacagtagttggaggtactaggaaagaagtgtttttgtcctgtaggacttgcatccagcctgcagctggcccaagaatggcacagtgctaaggaaagcagagctaagataaggagggggattccaatgacattgcttgagtccttcaatccaattttctccagacttccacttaagccaatgcatttccttcttctttttttttttttttttgcctatactagtttgagtttagtttctatcacttgtaatcctgagaattctaatcactaaaatttctaattgcccattcacatctgaagagctattaatctttgagtctcagatatagtttcattgcattatttcattctagaagcttcttcgtattgatctcctgacctttgtctgtttctcagctggtgtgtagctgcactaagggccaagtgtgtgttctgtctcccttgggtcttgttcagagagcctagtccagagcaggattcctatccctggttctatccttcccttcttctttcttttttctttatttactgagatgggtacttctggggtgttgagccgaatcaacagattccctgggttctccctcagttttttaagaaacataaactgaaaaaccagtctgtgctataacgtgtcacaggtgacttaataaagctaagtacagcatacagtaaagatactgtatggaaaagagggtcacctgcggggagggaaaaggcttcataaaggagatgtctctggaaagatgttcacttgtttgcttcatagacttcgaaagcaattctttctaggcagagagaaggtacaagaaaaggttctgaggcatgaaacatgcaggcaagttcatagaactccatctaatcagctccattaggctgtagtgtagattgaaatgaagcgataagagatgtggctggagaaactgaaaagggaccacagaaagaagagcattgaatgccaggctgagtttagcctatgtggcaatgtttcccaagtgtattttcaagataccccaacacacacaaatacacacacacacacacacacacacacacacacacatacacgttaaaaagtcaggctcccgggacctaatctcctctctagaataaaagcttctagaggtagaaccctgtatcttaggtcattcttataaaaccatcagttttggcacacccttctaaagcaacaggaaccctcccgcatcttcttgtgtgaccttgtcccacgctagatactaaaattccaagcaaacaaggctgcctctcccttccttcatgtctttgcttggctgtctccgctctttccctaatgtaagttgactcatcttttgaagccaaagccaaagccaaaagccaacgtcccaaggaagccttctacgaaactgaggtcccagctgaaactttctcttccggaccacaccaaagcacctgtccatactagttacacctcattgacatcccgcctactattgtattcacagaggtaaggcatgccctgtcttactctcaaatggactgtaagcttctgaaggtcagaagttctctaagacctattgtgtggtgggcacttaagttataatatcttgtttcattcttccaacaattccaagaggtaggtttaatgatctcactttacaggtgaggaaaccaaggtaggctggcatactgaaggccgcagaggcagataagggtagtgtggatatgatcctccttaccagcgttccctcgcagggcagggcttctagcaggtggccttagcccctgggccactgccatgttcccgggccaatgggcacttaccacacatcccgaggaatccacctgccggtcagacacacacttgaagttgcgagtgcagcccccattgttccgagagcagtcacgaactggcccgaaggaagacagcaggtcattgatggtttcaaagtatgtggacagcatcgcttcttcccttggagagaaaggggatggttaaaccccagagacatttggatccttagattaaaaaaataataatgtgaattcattacatttgaaaccataacttacttataatcaggaaaacaataataatcaatattataaaaaggaaacaacaacaggtataccatcatatgacacggtgcttgtcaagttgtgatacagagaaatggacctagaactctatactctttattttattaatacttatgattcttggaggtagtcatgagatgtgcactttaccgtaagggaactaggcttagcaaggtgaagtatcttgctgaaggccagcagcttacaatgtgaccgaagtgaagtttgtattaacttccagctgagtccaaagagaaggctcttctcactgcctaactcttagcttgcatcctacctgtttctacagatttcagagctccctatagcaactctgcaattgggcacatccctattattccaactttgtgaatataaaattgaaaccatgaaagattgtgggactgactccaaatcccacagtctataaatagcagagccaagacacaaacgcaggagtctgaccctccagggccctagatccttatttttcagactattgtgtataagtcactccatcaagactatcagcaacagttgttggaaaggtcatgggattccagggaaatacgtgattcctcccaaatgaggttctcaaaagataagactagacttgataccataatccatggatctgccaacattttatgagatggaattctctacaatggaggatacagatgggagcctctgatgctgtcttctgcagaaagggcccgaaataagagatacatttgctctggggtatatgattcccatacttacaggagattttaaagaagcaccatgggcagtgagaagcggcacatatccttccctggtctgtgcctcatgaggcccagagctgtgaagcaagggaaatgcctgcagccacacatgaagcaggaagaggctagcaaacactagagggggtgtctctgcaccatcttgcataccttctcccattcttctccacctcaggcttggaccaggtttgaaactcctaattcatttcctgcctccagtcttatcccttctgtcccatctttcatactgactgtcagtgaacttggtaaatcccagctctaattagatactcctctgatcaatagcttcccagtacttagagaagaaatataaattagcttctctggcattcggacttcataatcttgcccccagttacctgtccagccacatttaccctctcctcacatctctatccactaggcacaggcctcgtctcattccctgaacacagaatctctgaaaacaggttctaaactggaaagttacatgcaggaggtttattgccaagccctcttgggagatgcatctaaagatggtgaggaagggctgggcatagtggctcatgcttgtaatctcagcactttgggaggcctaggaaggaggcttgattgagcccaggagttcaagaccagcttagaaaatgaggcaaaaccctgtctctacaaacattttttaaattaccagggtttagaggagcctgcctgtggtcccagctactcgggaggctgaggtgagaggatctcttgagctacagtgagccatgatcaaaacactgtctcaaaaaaaaaaaaaaaaaaaaaaaaaaaaaaaaaggcaagcgaagaaggcaggatttggtaaagagagagactgatctacagtgcgggtctaaagtatcagttgttcctgcagggagctctggagctgagaaggccctttatggatgtcctgaattaaagcaaggaatccaggcctttgcatccccacagtagccagtcattggtggggctgctgtctggaatgggatatactaggataaaccagttccctgaggctgaaggcaatgcctagtcactgacagccacagctggtgggtgggtgggctggccctgaagaggggatctgtgtgtggtacctgcaggcacctctctcaatcccaaatcatgctcttccttctgcctgggatgcccatttccaaatgcttacgtgaagaaatcctaagaatctttgaaaactcttcatattcattcattcattcatttattcattgtacaagcttactgagtgtttaccatataccaggcacaatgctaggtgctggggatacagcagtgacatcaggcaagatcctgactcccaatctccacagtagctttatgttaccgcctttgtgaaaccttctctgttaattccccctactagaattaattccttttccctgtgagcatagtggctaaatcttttaacttattgatcttaattatcagcttcacagtctcccagagagactataagcttttaaaggaaaaggctcaagatttattcatttctctttagtccccagcacagtctggaaggaaagtgtgctaggtaaacattttcaaatgaaacacagaaaacacccaaaggcttagacgcagtcttcaccaatgagtacttttactaagaacctcctcagcagggcactcctctctgtctccccaactctgggtccccattccaaatcctttgtgttcagggatgcagcacagggacaaaggagaagggtgaggtgctacaggattatcccttgcttcctaactttgtagggagtgaggtgacaggtttatgggaggaaagaattaatagttcctgaaatgaagctctggggagacttgccacttttgaatcatgaagagagttgaggatcctgggaagacattaagcctattaaaatattaataccctagaagggagaagaagaaacagaaagtaagaggaggagataaggcagagggaccaggctgggcgtggtggctcacacctgtaatcccagcactttgggaggcctagatgggctaggtcaggagatgaggactatcctggctaacatggtgaaacctcgtctctactaacaatatagtagccaggtgtggggcatgctcctgtaatcccagttactcgggaggctgaggcaggagaattgcttgaacccaggaggcagaggttgcagtgagccgagatcgtgccacggcactctagcctaggtgacacagcgagactccgtctcaaaaaaaaaaaaaaaaaaaaagacagagggacctgagaaagtgagagaacaagagataaacaggtagagaaactgctgagaaggaaagaagagacacagagaggcagaaacacatatagccacctggaaacagataaagggatctaaaaggtatagatggacagacagagagacagagagttatagagggacacaggtcatagagacagacaggaaaagaaaggcaaatagaggagagaaaggatgtgaaaagataaaaatgaaaagatagaattggaaaaagaaagcaaagagagaaacagaggcataagaaacagatgaaaagaggaggcatactcaaggtaaacagaacaaatgtgtaagtgtgccgaggagagggagagaaggtgggagggagagtgagaaaagagagcaggaggagacaaatgcagaaagacagaatgaaagggaagagaaagacactgagtaagaaagaaaacacacccatctctactaaaaatacaaaaaattagctgggcgtggtggcgggtgcctgtagtcccagctacttgggaggctgaggcaggataatggcgtgaacccgggaggcggagcttgcagtgagccaagatcgcgccactgcactccagcctgggcgacagagcgagactctgtctcaaaaaaaaaaaaaaaaaaaaaaaggaaagaaaacacagagccatggagagcagagacagacaacaacaaagaaacaaggaaagggaagtgaaaaacaagcaaaaacatgtcacctttctctggaagctagagacagttcaagctataaaaatacaaaagctgtccacttttaaaaggattgattctgcataaacatcagttacatgaggggaacattacttaaaacacaaagacctgacacaggggccgttactaagtcaagagaagtgattgtgtcaggctagggaatgaagaatctgagcgcaagacaggaaaaaaaagcttaaagcagacactggcgttttcttaactcaaagcagacactggcgttttcttaactcgggggctcaatccttcatctcacttgcggagcccagggtttagggtctgtgggatcttagagctgccccaatcttggggcggggagtgggaggcagcaaagagatgaatggaagagcactgggggcggaggcaggctggactgagacactgccctggggtatcaggataccagtgtgagaatcccagctttgccagcaatcaccaaaactaccaacatcctcttcattatttaggatttcctgggcacctgctatgtgttaagcatggtgcaaggttcccttcctgtaatattccctgtgattttcacaagagccctagaaatgacagttttatacccaatgtgcagctggagaaacaggggcttagggaagttatgtcacttgctccagttctcaatggcgtgatgcagtgaggccaggctgtgcactcgaatctgcctgacctcaagtcctgagttaaactttaacaacttaccctgtgtcttgggcaagtcagagccctcctaacagtaaggcccgtaagaatgtgtgttcaatctctctgtcttagcagaggaggacagaatgggcagagcctgagagttctttgtgtacctcccacagcctgattcctgggccatgcatgtggtccacaatagcctcaatccatgcaggaatagaaggggaaagcatagtgtttaagtttactagaagggccataacaagtaccatgaatcaggtgacttaaaacaacagaaatttattctctcgccattctgaaggccagaagtccaaaatcagggtttggtagagccctggtccctcagtaggctcaaggagagaatccttccttgcctcttcagagcctcccatggctcccagccatgcttagctttccttggctggcagtttcaggactcctgcctctgtccccatcatcatatggccttcttgcctgtgtgtctgtgtgtcctctcctttttttaaaatgacaccatttgggctgggtgcagtggcttacatctgtaatccctgggaagctgaggcaggtggatcacctgaggtcaggagttcgagaccagcctgaccaacatggtgaaaccctgtctctactaaaaatacaataattagcagggtgtggtggtgggtgcctgtaatcccagctactcgggaggctgaagcaggagaattgcttgaacctgggaggcagaggttgtagtgagccgagatcacagcattgcactccagcctgggcaacagagcaagactcctgtctcaaaaagaaagaaagaaaaaaaaatgacagcattagttgggtttagggtccaccttaatctgttataaccttttcttagttatatctgcaaaggccttgtttctaaataaggccacgttctgaatttctggtgaacacaaattttgggggacaaaattcatgcaattccacagggcacaggggaatgtgctcacattcgcatggtaggacagagccaggactaaataaaacacctcagtccttgattcttatcaaagtgttcctaatactgcactggctcttctcactctagacacttcatgtttcattgtggtccttacaaggtttgaaaaatcttagggaaaggatcatgatgaagtcactctccatattatctgtgcctttatttgggaggagaaaagaccaactttaattaaatacctaccacactccagcaaccgtgtagagggttttcaaccactctacagaacagagcttggcaaacttttctgtacagggctagatagtaaagatcttaggctttgcaggccatacagtctctgtcccaatcactcaactctgcttttgtaatacacaaacaatcatagacaatatgcaaaagaatgaatgtagctatgtttcaataaacctgtattaaagatgggtgtagtggctcatgcctgtaatctcagctctttgagagactgaggtgggaggatcgcttgagcccaggagttcaagaccagcctggacaacagagtgggatcccatttctataatttttttttttttttttaattagccaggtgtagtggtgtgtgcctgtagtaccagttactcaggaagctgaggtaggaggattgcttgagcctggcaagtttggggaggtgggggtcaaggatttcagtaagctgtgagcatgctactgcactccaacccatgtgacacagtgagaccctgtctcaaaaaaaataaaaaataaaaaatactgtatttacagaaagacacagccagataaattattttctgttttaggtgtgaaaaccctgaagtcagtgttggagttaggagttgaacccaggtaggtccaactccacattctttctcctacatgaatcttctgaaactcagccttctcatctgtaaaatgggaacaatatctgtctaattctcagctctgtagatgactatgaggatataataacatgatatagaaatgtgttttccaaactctaaaacctaatgcaaacttattcattgtttattcattcaataaatatctgagtacctgctgcatgccacatactgagctgattattattatggcttttctttggcctcccagcagctgtttctgttcctatataacccagacattgtgcaaaaggttccaaacatctctctatctctgacatacaaattattattatttttttctgttaatactggctccaaaacagagatagccagaccccaccagactgggtgagacagccatcccctaattacctgaccggtaaagtacaaatgcgtcacctggattccatttggctgagtcagcccaagcctgatgcagggtgagcattaggcagggtggctgggaacagatgctgacatggcctgctgttaataaataccaggaaaggtctgtgtcactcatagagagatgtgaatggatgatgccaagccaagacagtgacaagtccctcactgatgcagattaatcattctctggtaatagccgacaaccttgtttcctgagctacctgggaaggaggaacctaagacaatgtactgataaaaatcaagctcagggcaggcacggtgcctcacgcctgtaatcccagcacattgggaggccgagacagacagatcttgaggccaggagatcgagaccatcctggctaacatggttaaaccctgtctctactaaaaatacaaaaaattagctgggtgtggtggtgggcacctgtagtcccagctactcaggaagctgaggcaggagaatcgcttgaatcagggaggcagaggttgcagtgagccgagatcgtgccacggcactgcagcctgggcaacaaagcgagactccgtctcaaaataaataaataaataaaataaaataaaaaatccagctcagtttttttattttaaagaaagaacgctttgttgagatataattcacataccatatgatttacctatttaaagtgtacagtttaagcagggtacagtttaagtgatcaatatttaaatattttcatcaacccaaagagaaaccctgcctctatcataagtccctgcctacttcctcccaatgacccttgtgttgggaaaccactaatcttctgtctttatagatttactaactctgaacacttcatgtaaattaagttatacattatgtagccttttgtgactggctactttcagttagcatagtgttttcaaggttcatccatgtttcagcatgtatcactacttcattccttttgtattgccaaatgatattccattatatagatattccacattttattcctctatcattagttggtggacattttggttgtttccacttttcagttactatgactaatgctgctatgaacattcatacacaggtttttatgtagatacatgttttcatatattttgtggctccccctgccctgggatttagggagccttctcagcccctaatagcatgagccacagtgtagaacagtagataagagggcaagtttgtctggagtcagactgccctgaggaggaatcccagcttcactcagtatgagaccttgggcaagcctcttctttttgagacagagtctcactctctcacccaggctggagtgcagtggcgcgatcttggctcactgcaacctccgcctcccagttcaagcaattctcctgcctcatcattccaagtagctgggactacaggaatgtgctaccatgccagactaatttttgtatttttagtagagattgggtttcaccatgttggctaggctggttttgaacttctgacctcaggtaatccagagaccttgggcaagtctcttaaaccctgagcctcaattttctcatctgtaaaatggggatattaatacctaactagcagaggtagcatgagtgatagattagggagcaaatgtgtcaaatgccaggcacacagtaagtgcctaacagctggtaataagtggtatcatctgaaagtccctcaaagttgcaagaaccatgccttgagaatgttgagaagctcaatgtaggagaagggatgaaagatctgagaccccacatggtccatttactcagttaaaaatgtttctttggtgctaggcttgttctgggtactcggctgggttcctgggagacacaggaatggatgtaacagagcttgtgctaggcaggaggaaaaacactaagctagcaagataagtgaggccacaggaccacaaagatgactctctctctcttgccagaccttggaagtaggagctcagagaaggctttttggaggaggtaatgttgagcctgagacataaaggatgggtggaaattaggtaaagggggataaatagagtgggttaaagaaattctagggagaaggaaagaatatgctaaggcctagaggtaggagatagaataccctgattgaggggcttcaagagatgcagaaaagctggactgtcaaggaggaggtgagatatggcaaaggctgaagcagaaggagtgccaggagccaggctagagaagattcctgtgtgccaggccatggtgattctggactttaccctggaagctatggactgccacccaaaggttaaaaagcagatcctgcttttatttagagtaatatcatagatgaatagtttacacaaatccttatggcaataatagttaatgctgattgtgcattcataatatgccaataaatggtttaagcactacatgtatcaactcacttaatcctcccccaaaacacaatgatgtaaatgatacatccccatttcataggagaaagaaactcaggcaccattttgaggctgttttgagacctgttaaggataatgtaggtaaagcattaggacagtgcctggcacatggtgactgctttataaggatttcttgaaaaacagcttccaggggagggatagggtgaggtggcacaagccacaggtaggtagatttgagcttttccaaagccagagacattcagcaagggaacactgtcttccaagttactgctccagccttcaggaatgcatactgaggaggcatggccattttcctgggatagttgtggcgggagtcaggcctccagtgcagagggtgtacaatatcatggtgataacaacattcacatgggctaattatctactgagaatttatgacatgagaactttggcttaacatagattatctcatttaataattgcctatgggattgtgctattatccctgttgatatggtttggctgtgtgtccccacccaaatgtcatgttgaattgtaatcctcaatgttggaggaggagccaggtgggaggtgattggatcatggcagagtggggaggcagtggacttccccattactgttctcgtgatagtgagtgaattctcacgagatctggttgtgtaaaagtgtgtagcacttgctccttcactgtcttcctgctgttccagccatgtaggacatgtctgctcccccttccccttctatcatgttgtaagtttcctgaggcctccccagctatgcttcctgtacagactgtggaacactgacccaatgaaacctcttatctttataaattacccagtctcaggtagttctttatagcaatgcagaaacaaacgaatgcctctgttttttcaatttgaaaagaaatgtacacactcagatgcaggacttggcatttacagaggtgagaggactggcagtgagtcctagtgacagagctgggttccaccctgggtgtatctgacttcggactctttagtgtcctgcctttctctttaagaagtctttccacccagagattctgggactggtgttttagctgacacttaacattctccttcctctagcaattatggtttgcactaatttaggttgatatatatatatattgctgttcagagtggtctcataacttcctgggagtgtcttgtgcttctgagtagcttgttagcttcctgcatgcctagagtcctcctcggtcacatcccttagtgcactgggcatgctgcagctgttcgctgaataagggcaggtgttgaaggaagagaagaagggcacaataaggcccatcagctgtgcagtctttagaacaaagagaaaatgattgtaatgtctgttgtccatctgtgtgatggaggcaataatattcaactcacagaattgtgggtcagaattcaaagagttaaaagatatgaaagtctcttatcaccaggctcaaacaaataaagatcctcaataaagagctgttgtgttttggaaatgagtttgtgcatttcacagatattgacccagcactcacccctggagttggaggttgggtatagacacagcctcgttttattgtacctcactttattgctcattgcagatattatttcttaaagattgaaggtcggtggctaccctgtgtcaagagagtctatcagtgccatttttccaacagaatgtgctcacttcatgtctatgcatcagattttggtagttctcacaatatttcaaaattgtgttattattatatcgtttatggtttggggagccctcattgcgctcatataaagcggccaacttacttggtaaatataaggcctccctgtttgctgagacaccacaatattgaaatcaggcctattaataaccctacaatttcctctaagtgttcaaatgcaaggaaatgtcacacatctctcactttaaatcataagctagaaatgattaagtttagtgaggaaggtatgtggaaagccaagactgatgaaaagctgggcctcttgcaccagttaggcaagatgtgaatgcaaagaaaaagttcttaaaggaaattagaagtgctacttctgtgaacacacaaatgataagaaagtgaaacagctttatttctgttatggagaatgttttagaggtgtggataaattaaaccagctacaatattcccttaaacccaaactaggacaaggtcctaattctcttcaattctatgaaggctgagagaggtgaggaagctgtggaaggaaagtttaagcagagattgattcataagttttaagaaaaggagccatctctgtatcataaaagtgcaaggagaagcagcaagtgctgatatattaatagaagctgcagcaagttatcaaaaacatctagttaacataattaatgaaggtgactatgtccaacaaccgattttcaatgtagatgaaacagccttgtattggaagaagatgccatctaggtctttcattgctagagaggagaagcctggcttcaaaaattcaaaggacaggctgtctctctcattaggggttaatgcagctgttgaagccaatactagtttaccattataaaagccctagggcctttaagaattatgctaaatctactctgcctgtgctctataaatagaacagcaaagcctgaatgacagcacatctgtttacagcatggtttactgaatattttaagcccactgttgagaactcctgctcagaaaaatgagctgtgatggagatgcataagaggttaatgttgttttcatgcattctaacacagcatccttttttgcagcccatgcatgaagaagtaatttcaagtcttattatttaagaaatacattttgtaaggttatagttttcatagatagtgatttttctgatggatctgggtaaaataaattaaaaactttccagaaaggattctccatcttagatgccatgagaaaaatttctgatttatgagaggaggtcaaaatatcaatattagcacgagtttggaagaagttgattccaaccctcatgaatgactttgaggggttcaaggcttcagtggaggtaataattacagatgtgaaaattgcaagagaactagatttagaggtggaggttgaagatgtgactgaattgctgcaatctcatgataaaactaatgagaagttgcttcttgtggaggagcaaagaaaagtggtttcttgagttgtaaactactcgtggtgaagatgctgtgaatactgttgaaataagaacaaaagatttaaaatattacataaacttgcttgataaagcagtggcagggttggagtaaattgaaaaaattcactttcaaaaagttctgtgggtaaaatgctatcagactacatcacatcctacagcaaaatcttttgtgaaaggaagaatcagttgttacaacaaacttcactgttgtcttattttaagaaattgccacagccacttcagccttcagtaactaccaccctgatcagtgagcagctgtcaacactgaagcaataccctgcaccagcaaaatgattatggctcactgaagattcagatgaccattagcttttttttaagcaataaaatatttcttaattaaggtatgtacattattttttaaacatgatgcaattgtacacttaataaactatagagtaaaaaataacttttatatgcactaggaaacaaaagtatttgtgcaattcactttattgtgatatttgctttattacggtgttctggtacctaacacacaatatctctgaggtgtgcctgtatacagaaaagagcaaaacaaacatgtgctttgtccctctggggcttacagttgttgggacaagtaagttcctcttcaaagactcaaatttctggtcataaattgtaaaccaaacctatcccctccttttttcacaaatcgcacatttaccctatttggaaaagtttaagtcttagccaacgggatctgcttagattgtgcggtctaaccccagccaataggggaaggacacagaaacaggaactgcattagggttaaaaaccccttccctcctttgttaggtgtgctcttgctattgtaaccagtgcaagcagcacccttctgcagaagtaaatgtgccttgctgagaaattttctatctaagtgtgggtttttttttggctatgctgagcacttgtttccaacacaggtagttattggaacagtcactcaacaaataactgccttaatatcaatatgtgtgtctatatctatggctatagctatgtctatgttatatctgtatctatgtgtatatatctatagctatacatctatgcctatgcccctatctatacctaaatttataattacaaactgtgatagatgctttaaaaatactgaatacagtaagatcatatggcagaggggccaatctaatctagggatttggggatgggagtgtggagtgaggcagatttccctggagagtatgagaccctgaaaccaaaccagcctgtggtatggtgaggtttcatcacacccaggctgtccccaggagagctgggatgatgtgtatcctccattcccacccccaccatgcacagtgatcatggagtccatcattcctctggcaaaaaaagccatcttctcctcctgtacttgttctgaccatttagtcatagaaattctcctcttcacttaaacacatttacaagaaaagaacaaacaatcccattaaaaagtaggcaaatgacatgaacagacacttcttaaaagaagacattcatgtggccaacaaacatatgaaaaaaagctcaacatcactgattgttatagaaatgcaaatcaaaaccacaatgggataccatctcacgccagtctgaatggcagtttttaaaaagtcaagaaacaacagatgctggtgaagctgtggacaaataggaacacttttacactgttggagggaatgtaaattagttcatccattgtgtaagacagtatggcaattcctcaaggattctagaactagaaacatcatttgaccccctgttactgggtatatacccaaaggaatatcagcctttccattataaagatacatggcatgtgtatgttcattgcagcactattcacaatagcaaaaacatgaaatcaacccaaatgcccgtcatgacagactggataaagaaaatgtggtacatatacaccatggaatactatgcagccataaaaaggaaggtcatgtcctttgcaggggcacagttggaggtggaagccattatcctcagcaaactaatgcaggaacagaaaaccaaacactgcatgttctcacttataaatgggagctgaacaacgagaacacatggacacagggaggggaacaacacacactggggcctatcagggggctgggggagagacagcattagcataaatagctaatacatgtggggcttaatacctaggtgatgggttgataggtgcagcaaaacactatggcacacatttacctatgcaacaaacctgcatgtcctgtacatgtattccagaacttaaacttatttttttaaaaaaagaaattctcctcttcacccacccctctttctcctaccctttgcaaatctcatccttattttgaaaaagaaaaaaaagtttcagtggcaaatgctgaagcttgaggattatttattcataaagtacccacatggagtcactgagagctcctccaagctctcatctcaaacagaagaggctcattaagatgggaagtcctggggtctcaggtgtgattgctcagaaagccagcaccttcccctggttcagggtgtgccctgctgctcaggagcctgagagactctggtgatctggatggcagagggggttgccgtgagccaggagagcccagcattagacagtaaatggggctgtgacctctagaaggaagagcactggcctggaggctcaggtatggtatcagagtccagctcagcctccctctgctgtgtgtacctgggtgaccctccaccctctatgggcctcagattctacatttctacaatgatggggtgatctctaagggctcttccagctccaatttctaataacataatgtggcttcccaaaaagactgacaactgcttccagttgtcagtttcactttcagaaataaggtgaaaatgcaagactggagagagacagagacagacagacagacagacagacagacagacagacagacagagaattcattgttttgaacctgaggaaatcaagggactgtgttattatgaggaagcagctctgggctcaaactctgctgctcatttgctgagaaaaccaacaacttattcaacctctcttgagtctcagtttcctcatacataaatcatagattataataccgaattcttagttttcatgagaattacattagataataaaacttccatgaaggcatgggttctgccatgctcactgaagtctagtgccttaaacagagggtctggaacactgtgcaggcaacccaatttgtttcggacaaatgaatgaataaaaacacacgtgaaacactctgcaaagcactgagcccataacgaagatcaatacacttgcttgtattgttacagtaattgttactaacaatagcctgcttttcaccaatcctaaaagttactcaagccctgagaacagggattcttaacttggtgtcaagacttgttttccaatctgatgaagcctatgaagcctatggaccacaacttagagttatgtttttatgtggataaaatcaaatgaaaaggcattctaaaataaaccatttatcaaaatgtatttaaaaatcaattgtaacataatctacatgttcctttattgacatattaagtaaaaatatctagtagcagatataataataaccataaattcaaagcaataatgagccaaaaatatattttaagacatttacaacaaatgcaatatgatataaaactataagtaatttccactggtgacaaagtcacaggtactgctaacacacctatgtttgttgcctatgtttgtaatagaaagaaatgttaaatttcaatgagtggctggcaaaagtaaagatgtatgattttcccatgaaatttcatgaaactccagcatagaccccagattaagagctgctgccaacaatgacactttattggaaaaagcttttctctgtatagctgtcactgtgaatataatcagaagcttgggtcctgataggaagacaggaaattaaaactcaactatcatcacaccaaaataattctttcctgaaggggcatatgtgatgtggtgaattaacagacttgggcttcagaaaataaataaataaataagtaaataaacaaaagctttcaggggtttgcccttgcgcaaatgacctcccacctcagaacttcagtttcctcatctgtgaacaagttgtggtaatgtttcctccaagggtggctggagaatggggtaaaatacataagataatgtcccttgtgcaaatatgcaaatactggctcttctgtgtctcccttcctgttccttctagggcaaaagaagtttattgcagccatccatggctgccataggtgccatgatggggatgaatttctgaatttcttaaggacttactaggttctaactccatgctagatacttggcactcacaggtgctgagacatgacccccgccttcaagaagggcacaagctggggcagagatagcaagtaaaaatttacatggtgaagctgagtagacacatattatagacacataaagacgtcatgaggtcctcaaaatgaagcgatgacttttcctgggctggctagagaaggctttctagaagaggtagccacacatggatcttgaagaaagatgagaacatgaggaggagaaaaggaagaaaatagaaagacaggatggctgctagacgacagcacaaacagagtcacagaatgtggaagaggaggaggaggaaggtgtgttgcataaatacccatacccaatgagcccattattaaagtgtgggatgggtgggagaaaagggagctcaccaggcccagtcacgtgtgttttatagacattttctagttcacaaggtggatctcattacctcattttgcagataaagaaactgagtcatttaaaagtcctataatttcctagtggagccctagtaggaatgcaactgcctctgactctgaagtccatattcttctcccagaatgccacttgttgaatttgagttggaatcccagttttgctttgtatctcactgtgtgacctcttgaaggtcactagtctctctgacttcagcttccttatttgtcaaatggagactatagcacctacctctcaggactgatattaaaacaaaaatgataagccacttaaagcaccacatgcattgctgggcataaagcaaaaatccaaccagtgtaaattcccttttactgcacttctccatttgcacctggagtggccactgcctttgcatggttttgacaggctagtggaaagtgcaatttcccaaaagatcccagcttatgtaaaacacaaggcacctcaattgcctacaaagagttggtttccgtaatggaaatcataggcagcaacaggccgtgttcaatctgtcagctacttgcaaaaattttagtagtagacagtgagttatggaaattaaatagtagtaatttcatttgctggataagaactatttgatgtttcgaagcatcaagaatatttgtagcacaacttaatgaatggagtttttatgtggtgaaaatcacaaggtaattacccagtgatcatcaataattgtaaaattgttaagcactcagtgcctcaagtgatgattcctaatttcttttggaacaataaaagaattatccatctatccatccatccatccatccacccatccattcatcactccatttattattacaaatatatttattaagtacctgctctttctggccctgcactcttagctgtcagatacgagtaagccatagcttctgtacccaacaaggccaacagcagtcttgcaaagtagaaaagacatggcagaaagactattagagaggtctgtaggagctcagaaagggaagaggttacttccagtttgagttcaagagagtgagtgaaagttactgtatggatttcaaaagacttcagtctttttgtatctgaaattttgaaccatgtgattaagtatacttgttaaaacataaataaatatgttattgtttcaaagatcagtgatgacactgagaaagaaggaaaaggtgacaacagtggaggcagaaaaggaggaggaggagaggtagagggtcatggactgagaacagtcattatgtttgagctagtgtcatgagtacggaggcagaaaacaaaaaactgggagactgcaatcaaagtgaggtggtggaaatgaaaatcttgagtgtaaactattctccaaaagcttgccaatgtcttcatttgtatttatttgacaagaagatattggcagaccatagtggctcactcctatgatcccagcactctgggaggccaaggcaggaggattgcttaagcccaggagttcaaggctacagtgagctatgattgcgccactgcactgaagcctgggtgacagacagagaccttgactcttaaaaaaaaaaaaaagtattcattttcatcaatcaagttggcaaatattcttgccaaatgataattctcagtgccgaagggggtgtagtgaaatgctattttcgtattccactgtgggagtataacttgccaacatttatggaaagcaatctggcaaaatgtatcaaaactcgaagtgttcgtacacgttgaccaagtgatcacagtaatcagttctagaggaaaaatgagcaatgcagatgatgacatatgcacaatgatgttcgtcacagcattgtttataatggggcaaaatgaaaatgttctacatatctaacagtgaggaaatgatcatcaacatatggttcattcccacagtaggatgtcctgtgaaagtttaaaatcatgatttctatgtataactgatgatatggaaaaagtttgttataatattaatttttaaaaggcaagaaaaattatatcgatataaacacatgaatgcacatgcccatataatccaaaaacagatattttaaggaagaggtagcatttaactgggttggatgtgtggagacagcagtgagactacatggtggacagcccttatatttgtttatataatatccatgtccctttcttctgataacagcacctccattttgggtttgcggaaattcacatccctctttcctcacacacacacactggatacattcttgtagatttttgagttaaggtgtcttgttttcctctgacttactgctgagcaggtgaactgacaattaagccaaataggtatttactcttgggaatctgaaactaccccctcggccttcctaagtggcatggaggttgcagatgcagaaatcaattgttcataaactatccacgctcttctaactcttgaaagttcttccaggtagcccatgaaggtaggcctacttggatttgcagactgatgcaggccaggcacaggagatttctagacagagcaatggcataaatagaactaccatctacaagccattatgcaacactttcattcagagcttctggatttgggacagcatgtcctgagttttgtcagtagaacagacaaagcttcaggcttttgagaacagtgttgagtgaagatgctgagtttcatgtagccagaccagaagggatgctagtcttgtggcatctgaaggagacagtagaagacaaaaggcagcagaagaggggcttccaccttgccttgtctccacccaggagagcatgaggcaagtagaaggtaaagatgaagatcaagcggagtgtgcctagagttcatcgttaatagagatgcttggtgaattccatcccacagccagacaggcaggcttctagacagtctagaagcccatgtctcttccagatctaaacttggggacttatgctgcctagcaggccatggaacacaggagaaagccatgggacctggattccaagagaaggggattcaagtccttctctgctgctagtgtgagaggacttggatagtcacttcctgtgatagtttgttagggctgccttagcagaataccataggctgggtggaggctagaagtccaaaattaagacatcagtagagttggctgtaatctgaggtctcactccttggcctgtagatttttcttttccctttgtcttcacatggtctttcctctgtgcctatgtgttaatctcttcttttaggaataccagcccatggtattcctctttgaataccagaggaatctcttgattcctctggggaatctcttgaaccccagacgcagaggttgcagtgggccaagatcgtgccactgcactccagcctgggtgacagagcaaaactccatctcaaacaaaacctcctcttctggtagtttgctagccatctttggcgtttttggcttgtagacacatcactctgatctctgccttgatgtctgtatgacattctccctgtgtgcatgtcaatctccaaatatccgccccccccccacccacttttttttttttttgagacggagtcgcactctttcacccaggccagactgcagtggcgctatcttggctcactgcaagctccgcctcctgggttcatgccattctcctgcctcagcctcctgagtagctgggattacaggcgcccgccactgtgcccggctaattttttgtatttttagtagagacagggtttcacaaatttcccctttttataaggacaacagtcatatgggattagagaccaccacatttaaccttaattgcctctttaatgaccttatttccaccagaggctggaaagggtgtgtgtatggtcatgggtgaagagaggttagttaatgggtataaatatatagaaggaataaagtctcatgttcaattagctagaagagaagactggaaatgtcccaacacatacaaatgaaaattactcaaggtgatggatataataaataccctgacttgatcattccacatcctttacatgtaacaaaatattaaaggtaccccatgaataagtataaatactatgtatcaataaaaaaagaccttatctcaacggagcacggagcacagtggctcatgcctataatcccagcactttgggaagctgaggtgggtggatcacctgaggtcaagagttggaggccagcctggccaacatggcaaaacctcgtctctactaaaaatacaaaaattagccaggcgaggtggcatgcacctgtaatcccagctacttgggaggctgaggcaggggaatctcttgaaccccagacgcagaggttgcagtgggccaagatcatgccactgcactccagcctgggtgacagagcaaaactccatctcaaacaaaacaaaacaaaacaaacaaacaaaaaaaaacctcttatctctaaatagtcactttctgaggtactaggggttaggacttaacacacaaattgtgaggtgacacagttcagcccatattacttctcttttcagagcctcaatttctgtatgttcaataaggctgtttgctcattcatttcaaagcatgtccatccattcatttactcactcattcattcattcaatcatttagcaaatacctattgaatgccaggtgttatcaccaggtttaggtttatgcaggaaaatatgaaaaaaatagtcttttctttatgtcaaaggggcaggtgggctttctgtgctactatttagagaaggttggggagaagacctcaggactgatcctcttgcctctacttcttaagagtctgtgaggacctacaacatcaggcagcaaaaaagcctagtgctggccatagacccactgtcagacagatctacagtcccaggaaacatgctattatctgtccacaggtctggtttgctctgtcagtttcattttagacaaggccactaattggcctgcctgccttgccagtgggaaaagaaatagtgtggggaaggaattggtagagacagtgctggtctgttaagtacctcaaaggcagactgcccaagcaatgtgggaagactgattcctcctgcaattgtttcttttttctttctttcttttctttttcttgaaacagggtcttgctccgttgcccaggtttcactgcagtggtgcgatcacacactgaaggctctatttcttagtttcaagcaatcctcctacctcggcctctggaatagctgggactacaggcatgtgccactacacctggctaatgttgttgttgttgagatgggttttactatgttgtccaggctggtcttgaagtcctggcttcaagtgatcctcccactcagccttccctaagtgctgagattacaggtgtgacctactatgcccgacttgctttttgttgttgttttgttttgttttttagtggggatagaacttggcatttcagaaataaaagaatattttttttattgagcatctattacatgataggtactgctctaggtgcagcaaaggcagcagagtattaaagagagtcctttccctctcatgcaggggagacagataacaaaccaatgaacaaggattaaagacttatgtggtttaagagttaaatattaacatgatgggagcttgggggagctgtggtggggcatgctgatttagtaaggaggtcagggatggccttcttgataagatcatcatggtgtaggctcatggacataatcaaatgggaatacgaatgcagtgattagcacagtgtctgatgtgaaacaagtgctcaataaatttctgctgtcgatgttattgtgaataatgtgctaagttccttatttgaatatagggacattatgcctatttcataaggttgttggatagattaaatttggaaaagcatataaataaacttacatggcaaattcaacaatggctgagtactagctaggtgagacagccaggggagacagacataaacacacatagaaatacatgcaagcacatcgtataaagtcagagcagggtaagtgaaagaaaagaagtcagggactcagggactgagatggagatgcctggggagaagggacaagctgtttaggatgggaggggtgcaggatcccccgaggagaggcttttggacagagggagaaagggaattctggaaacaaccagcctaggaaaaaaacgtgttacaagcagagagagcagcaggtgcaaaggcccaggggcagggatgggggtggcccttcaagaaccagcaggggccaggtcacagatagtctcagaggtgacagtaagaattttgagttttactataggccaagagatacacaatgcacaagtgttaaggagttttgagcaaagactgcaatgatgtaatttactttgtattgttgttgtttcgatttttttgagacagggtctcactctgccacccagggtggagtgcaatggcatgatcttggctcactgcagcttctatctcctgggctcaggtgatcctcccacctcagcctcccaagaagctgggactacaggcccgtaccaccacatccagctaagttttatattttttttagagatgaggtttcaccatgttgcccaggctggtctcgaactcctgagctcaagggatccacctacctcggtttctcaaaatgctgggataacaggcgtgagccactgtgcccagccccaatgtgatttacatcttaaaggataaatctgatcgattcattcaggtaaaatttcgtattgataatatatatttttcatatatcataagatcagcagtaacttatataaagtgtctgaccctcaatctaaaataaatgtattcattagacctggcatggtgggtggctcatggctacaatctcaacagattgggaggctgaggtgggaggatcgcttgatcctgggagggtcaaggctgcagtgacccattgctcataccactgcactccagcctgagtgacacaatgagaccttgtctcaagaaaaaaaaccaaaaatcaaatgtattcattcatgactactttgtgtaggcatgccagatacagcagtgtacatacaggcagtgacaacatattgttttctggtggatcttctgatggttttattgaaacagtgtagatgctcaataaatattctcatttgatatgaaactatatattatgatattattcatatttttatcactcttgctctaaaagtgatagtaagccttctccagaggttctttcttttgtttgtttgtttgtttttgagacagagtcttgctctgtcacccaggctggaatgcagtggtgcaatctcggctcactgcaacctccacctcccaggttcaagcaagtctcatgcctcagccttctgagtagctagaattacaggcacgcgccaccacacccagctaatttttgtaattaaaaaaaaaaataagttctggaatacatgtgcaggacatgtaggtttgttacataggtaaatgtgtgtcatggtggtttgctgcacctatcaacccatcacctaggtattaagccccgattgtattagctatttatcctgatgctctccctccccacaatcccccctcaaggtcccagtgttgttcctctccctgtgtccatgtgttctcattgttcagctcccacttatatgtgagaatatgaggtgtttggttttctgttcctgtgttagtttgctaaggataatggcttccagctccatccacgtccctgaaaaggatttagtctcattcctttaaaacacccttaatttttgtatttttagtagagacagggttttgccattttggccaggctggtcttgaactcctggcctcaactgatccaccagacttggcctcccaaagtgctgggattacagatgtgagccattctgcttgggctggaggctcattcttgaggaagagaaggaagcaaaagaaaaaaaagaagaggaaaaaagaaggcaagagggagcagggaactgccatgtctcaccactatctctctggatatgtggatgtggccttcctctcatatgcctatttggtggacttttattcatgtctcagggcccagctgaattatcacctcctccatgaagttagaagccctcccttcaacacaggcacagcagtgaaattgctgccgctggcctgttcacctccctggcttccgggtccatctctaatgaggccaatcccactgcataggagtatgctgtgtgtttgctcaccaggttgatgattctcattttttttttgtgcatcctcaggaattagaactggttttcatgtgtgcctggtataataaatgtttagcgcctggtgcagtggtggctcatgcctgtaatcctagcactttgtgaggccgaggcagaaggatcacttgagccaaggagtttaagaccagcctgggcaacatagcaagaccttgtctctacacacacacacacacacacacacacacacacacacacacacacacacacaaataagaaaattagccagatgtggtggcacatgcctgtagtcccagatacttggaaggctggggtaggaggatcacttgagcttaggacttggcagctgcagtgagctataatcttgccactgctctccagcctaggcaacaaagcaagactgtctcaaaaaaatgaaaaataagaaagtttaggaaagaaaggaagaaagaaagagaggagggaggaaaaggaaactaattctctcctccttatttttccagataatgctaaagctcatttcaaccagcaagtgctgagtttattgatcaacatttcagaggtattgaactgagtttgtattgacagaaataactggcaaccaggcagggggagcgagaaatgtgctgacagtcagcaaatcatacgcctggtattggagagcctgtctatgccaaaggggacaatcattaatttcctattccttcatagttacattccttgggttgactgacaagttcattttggggattcatctggccatttataaataaactcctttcttattccatattcctaactgcacctgccacgcagatgatcggctgcctggcactcacataaaaatttcaaattgctagcaatagctcaacatggtagttaaaggaaatcttctggttattttatgatataatcaagagaacccatttccccaccattgtagatatctcaggtccatgcacaaaacccaagtgaatttcattctttgccccctaaccacgtttaaataaatgacatccaagtacatagctgtaaaatgatcttttgacacttaagctttcgaaagtcccctgtcaaagctgtgtgactctgagtaagtcactgaatctctctgagcttgttttcttgtttgaaagatgaaaatgtattcatggcactgctgataaggtcgacaaggtaacagaagttagcatgtttaaagctccccagggtggaaagaagcttctaatattatctcattcagctccaagaagagaagtgaccttttccaggctggtaagtggcaggggggtggagcgggggtatatgaactcagcaccgcctgaggcagctgctcacagaaagaaaatgtatcattgatcttattggtgattttactcctatgcttggtctgaaattccatttggtctcagcggcctcaaggttagcataggaagaattaagctctctgttaggcttcacatcaacaaggcaattctagttcatctagaagtaattccagggcctccaggagtcatcaaagcaaaagttcttagagcccaaatgcctggtgctgatgtatctaatgtattcattgttcagtgtattttgctagcagtagccagatgtaccttgatatttgcattagtatacaatttctcttaaagactgtttatattttaaaaggttttgagtagtgctaactattaacttgggcaggaaaaattctctgctgaaagaaaatcgggcatatgtggtggagctttcaggctaaagcagaagatatttcgcttttgtttactcaacagatattttctgaatacctgcctgggtttgtgtttggtggtattctgtcactgttgctctttttcagctttcattagagtgaggaagatgaacactaattggatcatatgtttatcaagtgtttactatgtgtcaagcagtgagctaggcacttagcatatgctagttatcttagcccaactgtgtaaagcagcaactacgttacccccactttatagatgaggaaatgggggcctaaagaagcacatgggtgtgcacaaagtcccatcgctgggagtatagggtcagaatacagatgcaggcaggctctatgacaatgggctttgatgagtcagagtcacttgatgaacttaacatttggcctctagtccacgaagtgagttgatttctgctgagtgatgggcacttggtcatccattttactatctttccactttcttttatgtttgacatgttccatgataaaaattacatatatgtttttaaagtacagtctctggagctagactgcaaaataggaataacaataccatcatccttatgggattgttgtgaggatgaaatgaattgatacaaacaaagcatttagagctgattgcattggaaatattcaaggtatataagctattacctactataactgctaagatggaaaaccctgtagtgtttagcatatatagcaagtcccctgcatgaggtcctgaatatgacagactactgcacattttcctaaaattttaagttatctgatatgcctgaatacataaactttgcttagaaatataagtgaaccagtctcatatctaattatagtatttcatttactactttagtaatagtgatatctatataatatttaaaatcacttatttataataaataaatttagaaatactgttcttgctcactcttttgtttcagtaaaactactttattgcaattcttcacatataattcttgattcagtctaacgtctctttctcaagcagttgctatttaaaataaattagttgagaaagtaaccttcatgtgtgagaaagtcatgcccaaattgacagagtcttagcttaggaacggttttaaggtgtagatgccagtcttatataccagcatttacagtactgtggtttgagggctgatgaattgttgacctggctggtgagagtgggtggggtggctgggagctggttgctggaagctctgagaatgaagaggtgagagcaaaagagagaaggcagatgaagccaagctggtcccggtcagattgcactgacttttaatctattttttttttcattataaaagtaatacattgctgctggaaggcatttggacaacatcgaaaagtaaaaagaaaaacaaatccattaatcccactgcagagagggcactgtaatcgttattttgctgtctttgatccaagcatgaatgctctttctctagataacctcatggctcaaatgtcacctgctcagtgtcatgggatgactgcctaatatgaggactgtcatatttagcaaataaaaataaaggcacccaattaaatttggattttaaacagcaaatttcttttggtatacacacttcccaaatagtgcaattattaattgcctgcctgaaattcaaattcaactgggtactcaatattttatctggcaattctatcccatggccgatggcacttacaccccttctccattctccggtactcccaaactcccaacacctaaaataatttatcacacttattatttattttctgattcttcccattagaatgtaaattacacaagagcatgagtttttatctgttttactcattgaagtgttgccaaaatctactaaaggtgtatcacacacacacacacacacacacacacacacacactttagaatcttactatacatataccttcatattcttctttttccttaatcttactccaaggacatttcaggacacttttttgtttctttcaaacacattattttcatggctattttgaagttgcccaattaaatgatccaatcccctattagagaacatttggttgttggaagtttttctccattataattagtgccctgatgggaagctcagcaggactgcaggtgcctaagattctgcccactctaaagcaggagagatctaggagtaattctggctataccctcttactagctaggtgactttgcacaggtcactgactcttccagcctcagtcccccagttgtaaaccgagatgctagtagaacctggctctacttggtattgtttgaactcaatacgatgatgtgtcagggttcctggtaggtgcctgcatggagtgagcactcaccaagacatgcagttattattagtatcattccctacctcaacacctctccctccctctctcctctcttccctcctcaccttagtaattatttccctttatgcaacaggccaaatctatccatttccaagccaccatacttcctgcttcttaggtccataattgctttctctatcccaagcccactgccaggttaactcctgctgatttagggataccaagagagatcagcctttgaagcttttctgaacactcaacgtctgcccccaggcccacgcttggtcagaaccctgcttgagcatccacatttttcccattagcacactgactacctcgccacacaatggcctgggtgtttgcttttcacttcatttgagtgagcatctgcagaaaagcaatgactagccttccctacttccattctaggactgactgagagccttcttagtgtcctgccctgcacaagcacaggttagagggagaatccactaccaaaaaaatcccagacatttacttgccagttcctagatcaaaaacatgtgggcctcctttctgcccctgaacccagagtttagttgggcattattcttgttcttcaaaggaagtggtaggtagggacagggtggatggtaattgatatttcatggtgactgaaagacttgtaagtacctatttaaaaaaaagtcaatgactccattacaatttaaaagaaaaggagaaaaatagccaaatgacagttatcacataaagataggagccagtaccccactatgagtttgaccagcatgatttgtaattctgagaaaatcctgatgatagataaaatattaccattgttctaattttatttgtttatttagttattgagacagggtctcactctatcacccaggctggagtacagttgcataaacatggctcactgcaactttgacctcccaggctcaagcgatcctcctgcctcaacctcccaagttgctgggactacgggtgggtgccaccatgcctgggctggcctcctgggatcctgggctcaagtgattcttctgccttggcctcctaaagtgctatgattacagacgagagccaccgatgcccagcctattctcatgttgtaggtcagtaaagaagttcagagagggtaggttatttgcgcaatgtctcatttaatcaggggaggagatgggattagaattcaaggtcttcctgacacccaaacctctgcaaacagtatgaatttaaggctccacaatagatactatgatgtagaagcaactgattttccaaaaggttcttgggttatttatttattgcaaaggcattttacctccctgcacatttatgtaagtggtcccatgagttggtagaattctctgaaaaccaatacattctgaaagcaagcttaatacatttatttgtacagattgagcatccctaatccaataatctgaaatttgaaatgctccaaaattggaaactttttgagtgcgacatgacacctcaggtggaaaattccataccttttctttctgccggttcaatgtacacacactttatttaatgcacaggattgttaaaactattgtatacaattcccttcaggctatatgcataaggtgtatatgaaacatatgaatttcatgtttagacttgggtcccatctccaggatatttctttatgtctatgcaaatattccaaaatctgaaaaagtcagaaatctgaaacacttctctagtcccaagcatttcagataaggggatactcaacttgtacttagtaagcaccaggggtcaagtctttgctaggagaccaaagggatgctctgtatctattcataagagggtggaagtggaagcggtcatggttttggcacaggggcaaaggatgtgagttagaactggatcctggaaggctttctgaaaggagtttggtagtagtatcctatcaaggtcttagtaatctgggcatagtttctgcagaatcaaattctcctatattcaacaggacagcaaatgaagactgtattgattttctgcttagatcaataaataagataaattgaccagaagggctaaatactgatcagggtgaactgaacatcaacatttactaagagcagagggaggagaaacataaatatcagaaaaatggagatgccaatagagcactggggcagtggctcagtttccagttaaaatgtgtgtgtaaggattattattttagtcatgtctttacataaaaaaagggagtggaattaggttattacaataaaacttcatttagtcagactgtgagaagaccaattgatttttaaaaaacaataaatgccattgaatttaaatgcatggatatgatatggcaagacaaacaaataaacaaatagtcagaagacctgagtcattaagtgtccttgttaagtgcagaaaatcacatattattcataagtgtattctatttgccaagcacagaacctggaatatagatgaaatcttggattgagttctatgagagctgacccagagctaaggaatgtggtaatagtagttgatttgggaggtgattccaggaagcaagtgagggactgagaattgagccaaggaatggaggaaagcaaacaagggtgtatgtattagttcattttcatactactataaagaaatacctgaggctaggtaatttattttttaaatttttattttgatttttttatgagatggagtttccctcttgttgcccaggctggagtgcaatggcattatcttggcctactccgcctcccaggttcaagcaatcctcctgcctcagcctccagagtagctgggattacaggtgcctggctaattttatgtgtttttagtagagacagggtttcaccatgttggccaggatggtctcaaactcttgacctcaggtgatccgcctgcctcagcctcccaaagtgctgggattacaggcatgagctgccgtgcccctcctagactgggtaatttattaaaaaagaggtttaattgactcacagttccacatggctggggaggtcttgggaaacttacaatcatggcagaaggggaagcagggacgtctcacatggtggcaggtaagagaagagggcagggaaaactgccatttataagaccattagatctcatgagaactcactcatttaccatcatgagaacagcatggggacaccatcccagtgatccaatcaccttcctcccttgacacatgtggattacaattcgagatgagatttgcgtggggacacagagccaaaccatatcagtgtgttaatgagggggctaccaggtgggcaacaagaactcgatctcgttatggtctctctgagagactgggtaagatacaaccctgaatctttctgtgaaggggcaagaaatgtggcatatttttctaccaacctcctgttcatcttttgctgtggattgtgcctaaggccatcatcactgcccacctgctcccaaaaaaataacctcaggcagacagatttaggtgcagcgcactgaaggtgcaggtgacagctgtcaaggaccaaatgtagatgggaaggacacatggcaagtggtaataccaggcgaaggactgcaagatcaagctctgtgctctgtgacgattgtcaagtcaatctcctctctgggcaatcagggtctaactctaaaaagcgaggcttgaatcttcacattccctcccagactgagtgccagtaattctgaaaaccagatggtcaaactcacaatcaaggattacaggccatttaggaaactgcttctcacacagataaaaatgatacatgatgagcattccacttgttagcgtttaactgtgagcttttcaagtgcttgaacatacacacaaagatgtacatgcactaagtgatcactgaggcattgtttgtagtagcaaaaaactgaaaacaacctaaatactcttcagttaggacatcgctgaataaaactggcatattcatatgccggaatgttctcctgcacttaaaaggaacgaactgaatctatatgtgtcaccatgaacagagttcaaaaaatattgctgagagtaaaaaaaaaaatcaagatgcagaatgttatatatagtctgacaccatttaaaaaaaacaagcacacattacagcattcctatgggtaggttacatatctggaaaagtatttttaaaggactgaagtgacaacacaaactcatttaaagttattttggaaataacttttccaaaaatcacatttatatgagtggctacttttgggcagggagagctgggacaaagactagattagcaatgacaaatgtggatggggtagtcagagtgattttagttatagtgatattgttctaatttatgaaagcagaattgattcatgcatttttaagtgaacttaaaaaaagagagaaatgtctagtacgtagcctagtatcacaggagactacacgataatgtggaaggagtttgaagctggatgcattggctcgtgtctgtaatcccagcactttgggaggccaaggtggaaggatcgcttgagtgcagaagtttgagaccaccctgggcaacatagtgagaccctatctctacaaaaaatagaaaaaatagcgccaagcatggtggtgtatgcttgtggtctcagctactcgggtggctaagatgggaggatcactttagccttggaggtcaacagctgcagtgagctatgatcacaccactgcactccagcctgggtgacagaacaagaccctgtctcaaaaaaaaaaaaaagagtttggaaaatagagtcagaaagacctggtgaacctacttcgcaaataacttctctgctaagagccttcacttcttcagttccaagattgacaaaacagaccaacttcatgaagccgagtgaccacagggcaacctgtagtgtcttctgtctggatcataaatttgcattcatctcctgtttattccctgctctcttatctgtgttttttcatattttaaaaaagtgttaaaaattattccttttatgttttttatttttttgagacagggtctcgctatgttgtacaggttggagtgcagtggcacgttcacatctcactgcagcgttgatctccctggctcaagcaatcctcccatttaagccacccaagtagtgagactaaaggcatgtgccaccacacttgcctaatttttttaaatatattttgtagagatgggtctcactatatcgccctagctggtctcaaactcttgggctcaagtgatcctctttcttgccttgacctcctaaaatgctgggatttcaggcatgagctaccatatgcagtgttatttctttattgagttgaaagttgaggttcctgcctaacccccatggaatcaggtatttgattaaatagactcagtattaacaaggttttgatgttttcttaattcctatagtgccagttgatattggaactgagcaaccattcagctacacatgaatataccattttacctggctttgtgggtatcagtgattatcaatgaggaggcattccacaatgacaacactagggggtcttatcaaagtcaaagggacataccatacacctgagttagaactgctggagttaaatccaatcaggagaagctgttagggcagactggccttttccataatggtgtccaaaggtgttcaggcctcttgcttttacatgggctgtttcctcacctggaactctgttctctctcccaacattcccatgcccacatcctattttcctttaggttattttctccatgttgccttcatgaataaatttcctccccacaaaataataatgatcatgaaccatcctttgcaaaattataacagtgagaaaaacccaacataggagaaatatgacagtggaagatatctgacataaccaactccatcttgcttctaacctccaagctatccttgtttattcctggtggaggctatggtaacctcaggaggaattcagtttacagtttaactttgaaacaaagataataacagctccttcctgaaacaaaacccatccttgcttggagaccacactgcctttgtaaaacaaacaaattagccacaggattaaaagttatggctcaggagtcatgcagccagagatcacaggattcctaacctccccaactgctcctgcatataacactactgttgtaaaacctaagattggtatttgaggtattttttcacatcctgcattccgatatccaagcagacccgtaaaagtggctcatctggtattgtggcccccacctaggaactgactcagcacaagaagacaagatttaactccctattcatttcatccccaacccaacaaatctgcattccccattccctaggcccctgctcgtcaaactatctttaaaaaaccttagcctccaaattttcagtgaggctgatttgagtaataaactcctctcctatcacttaactgaatctgcatttattaaactatttctctattgcaatgctgctgtttcagtaaattgactctgtctgtgcagagggcaagaaaaacctgttgggcaatgacaatcatgatgatgatagttaccatttgtagacaccatgctggatcctcatctaatcctcatagcaaccctgacaactaagcctccatattcccattttatgaaagaagacatcaagattcagagagtgtggaaggacatgacagagaagggtttgtcatttttttcaggggtgatgctttttgatcttctcccccctcaccacatttatggctgcctggagtctatggtttctgtgatatgtaatttgtagagagagaaatcattttgaggattttttcttattgagagctatattcctaggcttaaccctcagaaatgaaaagtttaaaagttaaagtacaagtcagagagaaaaaatagagccctctgaaatgatctaaagtaagaagtcagaccgattcttcaaggcagcacacacagaatggaggcaaggcaggaagcctaccattggttccagctcatcctgcaggaaggatgaagaggaactaagccatcacctcacctgcttcctccctcccttctccatctccctctttcctgcccccctctttcttctccctccaccttcgtttggttctcaggctccacaggaaataagtgggaggggacagcacatttactttgtaaagcaataaggagactgcttctctacgggctttattttatttttgccataagcttctcccggcttgccagcgggtaaaacgttttaccatatccaagaatttctttctttctttttttaaactggacttcctaaaaatgaagaaagaaatgtgaaaaatttgttcaaagttaaacatagaatgagtggctgtggttgcaattttacctaaattccgactccaaatcctatttccggctactgattgtgtgtgtgtgtgtgtgtgtgcgcgtgtgcaagtgtgtgaaagctgcattattcatatggccatttttactttaactcaccttatatgcccatatgcccaggcaataacgcattgcatatatgacagtggtcctttaaaattattttggaaggctgggtgcagtggcttacacccataaggaggctgaggtgggaggatcctttgagcccaggagtttgagaccagcctgggtaacatagtaaaaccttattgctacagaaaaaaaataatttataattagccagacatagtggcatatggctgtagtcccaggtactcaggcagctgaggtagagggttgcctgagtttaagaggttgaggcagcagtgagctgagatcataatggagctgaaaaattcctgttgcttaatgacattgcgacagtctgcataacattgtaacaatgcattaatcacctgtttgtggtcatgctggtataaacaaacttactgaactgccagttatataagagtatagcacatacaattaatgtgcagtatataatagttgataataataatacatgactatgttactggtttatgtatttattatagtatactattgattgttattttagagtatattcctacttatatcttttaaaagttaactgttataggccaggcacggtggctcacgcctgtaatcccagcactttgggaggccaagatcacccgaggtcaggagttccaggccagcctggccaacatggtgaaaccctgtctctattgaaaatacaaaaattagccaggcatggtggtatgtgcctataatcccagctactcaggaggctgaggcagaattacttgaacccgggaggcagaggttgcagtgagccaagatcatgccactgcactcaagcctgggcagcagagtgagactcttgtttcaaataaataaataaataaataaacaaacataatataaaatgaaataaaataaaataaaagttaactgttataaagcctcaggcatgtccttcaggaggtatttcagaagaaggcactgttaccataggagatgacagctccatatgtgttactgccccagaagactttccagtgggaaaagatatggaggtggaagacagtgatattaatgatcctgaccctgtggaaacctaggctaatacgtgcatttgtgccttagtttttaacaagaaaagtttaaaaaataaaaatagaaaaaaggtttatagaataaacatataaagaaagaaaatatttttgtacagctgtacaatgtgtttgtgtttcaagatgtgttacataaaagtgtaaagtttgaaaaatgaaaattttataaagtaaaaaatataccatattttggtgtacattttctatgcttagatacacaaataccattgtgttacaattgcctacagtattcagtacagcaatttgctgtataggtttatagcccaggaggctgtgtcacataactaggtgtgcactaggctatactatctgggtttgtgtagtataatctaggatgttgtcacaatgacagaatcgcctaatggtacatttctcagaagatatccctgttgttaatcgatgcatgactgtatatccttttggttctgctttttctagagaaccctgattaatataagtctatcctcaacaaagctgccagaggattccttttgaaacttagggtagatactgttccttatctgtttaaagccttccactggcttccaggagtaaatgtttttttacttctttactttacaactttttacttctttaaaagtaaaagttaaggctattcccatgtctttgaagagcccagtaggatctgaccatccattaccactttgaccacatctcccattacttcccccaactctgtctcttgaaacaccagggattttctgcctcagggcctttgcacttgctgttgttctctttggaatgatattttccagacatccatatgctgcattcctcctcctcttcacttcctcctcctcctttttatttgcccaaatactgtattcttgggagagcttccctgattcttctacttaaaattgtggctctcaccccaccatcatcactcttaagcccctgctgtaattttaccctgctgtacttttatggcacttattacctcgaatctactgtataatttacctgtttatcatgctattttttgtcttctccccctagaatgtaaaatcgttgttggcagagatctttgttttatatactgatgtttacttagcattagtatctagtacatagtggatatttgcgaccaattggattttccaaagctggccacaacagtatctcccatctcacacgtacctcttgcaatgtgaccttgagtgttagggtctcttaagaaatggaaatgacccaggactttctgctgtagaaaacagacatagataccactcaacaggtgaattaataataactgacacttctatagcaaaacttggacatatcctggcctgggtgctgaacccacctcctcctcttctggatatgagacatactctctctctgggccttaggttccttgttgagatggactaaatgagatgatatagggaaagagctcagcccagggtgtggcatgtgagagtcatgaggctgtattaatagtttgacatttgtttttttccatgcagaggcctgaggcccaaaggaaagaggtccaaaaaggcctgtttacctctacatcaggctgatgccctggggatgtgcttcacaggggactggcatagcagatgggcaagaaggggccagctctcacttgccttctagtctctgccaggaacacacccctccctcagcttttgggctttccaatgcctgatcaatgttcatgtctcagatcattagttgcatttgaaagcctcccctagtctcccagggttgagagtttctgctgtgcgccacagggtccccatccttctaccatccttgccagaatcatgtcagaatgtgagtgttgtatgtccctctcattcaactgcacatgggtgaggacaggagtagagactcccttgcttctggtacagctctaaggcctaccacagggcctggcatacatacggtagaaattgagcagctctgggaagtgtgtctctccaggacacaggagcatcaggggttaaggctgcagaaggctcctatgtcctcgtggcagacagtctcaaagggctgcctgatggggtaggacacagacagtctgaggaataaccatgaggtggcaggtgggaccgcagaatgacactcacagtctggtcaggctgttcatatttaagaggctgtactgtgttgtggttcaagtcctgtcctgggagccagactgcctgctctccaatcccagctatgttgcttactacctatgggacctcagacaatttacttcagccctgtgggcttcagtttcttcatctgtaaaagaggaataatgaggttacccatcttagaaggttggaatcacaaagatcaaatgagttcattaatacatgtaaaccactaagaatggcacttggcatagttggagtgctatagaagtgtcagttattattaatccacctgttgaatggtatctatgtctgttttctgcagcagaaagacctaggccatttccatttcttaagaaattcacgacaaacaggattacaaaaataaactcaagattaaggctgcgtgatgaacatctctcaatctttctggagtgtacagtggctgtgcactctagaaattcatttggtggtaacgttacagctctatgtttgcagccatttgtgactatgaggcccaggccaaatgcccttccaccctccgcacccccaactctcctccaagtcctccaaaggcccctctgtggtcctattttttggcagagaatgaggagcaggcctggccttctgaaaccctctccactcccagccttgggagcctcttgtctccccctccttccttagagtcttggctatttgaggaaactgaaaagactgcccagggagctaatcttgggcttcacttctggaggggccgcgggtgggtggggaggcagattttcctgtacagaagagcgtgtgctccttttgaaatgtcctagcggaaataaatgtacaacctattgtatgctgccaggagccaccagcaggagttggtgtgatacaaaagcggcatttgtaatggcacaaaacacttagcactttaccaagacatgcacaggatataaaaggagacgaagggcctgacgaatccgccaagaaagcagcgtgtcctgaatgcaggagagccaaccactacaccccaacacacagtctttatcctcttaaccatgctaccctttcgttagtatagaagggagtatttggacacaggcaggaaagaccaggtcggtctccttcatgtgccttacactcagtcacttgcctttgtcttcctaagcagatgggcccgcccctcacattcacagtgcccagggcaagagaacaaattgcctagtacaataagactaaataatggaaagctatatattaaagtaacaagacactaaatgtgttttatgctcttacaatgacaaatataccttcataacaacctggaaggtgaggctcaaatttagatttactgaatttccttggaagagtgggtggcttaagggtagacctccaatattcacggtgctcagggcacccagatacacagggaagcacagcagtaagtgatccctgttttttttttttttgggggggggtgcggggggtgtgccgtttaagagcctaggagtcagacatcctcattcagagatgtggaaaatgctttctctgtctctctaaagctttgtttccccattttcccctttgcacttgtgcccttcacagccttggagaagcagcaggttcctgttctccactgaccctccagaccttagatttctgccaaagccagaggagagacctcctgtgcctcacgctcagtgcttggggctcgagatgaccagggaaggttgcaaggaccctgcccccaaagaattcacaggctcttgggaagacaagaagcccaaattcacctgagctactaaataacataagtgataaggatcaaaaagagtggatggtgtgcaagatagtcacacttgaggaccaaatcctgggaaagtggcccagaaaggaaccagaggaacctttttgttcaatgttagggaaaaacaaaaggcagaacctttcaaaggaaacatgactttatgtggaatctggacataggaaactgaagaaagcaaagctgtgcttttcgggagaagcaggatgggagtggggaactgagattccagcccccccagacacttttgtctttcccccttccatggacagaagacccttctctcattccactcttcccaacgcccatggaatgccaggtgtctgggcagccctatgttaaatactgttggtctagtctaatcttttaaagtaaaagaagaatggttttcttatgtgcccctcaccacctatagactgtcagcttctaggagacagcttctggaccttgtttttgttttttggtttgtttgtttttgtacctcagagtctggtatttggtgactactcagggagtgtgagttgagatgggttgaaggggaaatgtcagcccagaatcagaatatggagggaaagacttgaggtaattcaaccagcaaaataccgcaattacttttgtgccaacctaataccttgaagttagagttttatattattatcaataaatatcatgaaatctatagccccttaaaatgtctctattaatatttttctagctcatttccctgtgtagtatttgtccattaattatcttacagtaacaattgctaacctttattgagcaactataatgtaatctttactacgagcattgcattcattttctcatctgactctcagaacaaccccttcagctaggactatgattccctttatgtagatgatacactaggattcaaagggcttaagagaattgtacgagatcactcagctacaaagtgtgaaacgtggagtaggacccacagtgtgtgtttactgattgtttaagaagagtaggttgtagagtcagtaatgtgggggacccgttcccttttccctggcctgcagcagcagagctgggtagtgaatttctctcactgcagcttagaagcctgtgtctcaggctttcctcagaagccaagacacctcagttttcagtactggccctgaggcacatcagagagtatgagacaacccctcagggaagtgtccgaggcaggctccaagaagtgacagcttgctcaaatcccagatccaggaaaagcttctgacctctgtttcggagtgtgctgcacctttgtctggaaaggcagacctgccttcatgggctctcccattggtgttaagcaaggctaaatgggggctatatttcactctagaagtggctgcatttcaggagcagagtgtgattaagaaagatggatggcgggtaatatccgttaccaacacctgtaccgtgctcagggatctatttggcagaaaggggctatgtaagagcaagatcattaccatttgagctagaaaacaaaatgtggtggaggtggtgaaggatgggcggaaatgggagggaatggaggatgacagaaggcgggaggtaaggtgctgcaggaaaatcctatgctgcaggacgtgggtccgaagcctcctgggcctcaaattccccctagtaagatgctgacagccttagaggttctgtcttgctcattactgaaggctgtaggaggcatcgtttggaggcaaccacacccaacagtaagactaggtcagctctcaagaatagccagaactgagttattagctaaatgcggatagcctcacccctcacattttgagaggcaggatctctggctctggaatctcaaacctgaagcataaaggcttgcagggtgaggcgtgtgggcgaaaagaaatgacacagtctatagatctggatgggttgtggtccaaattcttccacatatcttctaggttaacaaatttgagtcaacattttcagaaagggagagaaagataaaaggagcttggataagactaaaatagactttagggtttatcagataagggcaggtttcagttctgccacttgtttgctctgtaagcccaaatgagttgtagtttttctctaagtcagccttttcctcatctgtaaaatggggaaaaaagacccacctcacagagttactatgagtattaaatggagtaatgatttataaattcttagtacagaacctgccagacaattgactcaataaatggaggctatcatttccaacctcttcctcaccataaaaacatgatggtcaccaccaccatcattagcctggatcaagaaagctttctgtttttattctggttgtttcctttcttgaaagtctctcgcagagccaaaggagaaccttgttctgtgtggctccagaaggaagacaaaatcaactggcatcaaactacagagagaggtggggaaagagcagggtgagaattagcccacatttgacacttccttttcattgttcagagcagccactattttctgtttgagaagctgtgtatgcagagatgcatatcatgtgcctataccatgtgtggcattataatgtatgcgtgtataatatgtacattatagattatgacatacacatgcatgaagtagattcaggagacctgggtgaagtgatggggctacttgtacatctgggtgaagtgcatttcctgatgaggaaatgggaaaggcaaaggccctgaagcaaaactaagcatggagtgctagaaggacaacaaacaggcgagggactggagtgggatggtggtaggaactggtaaaagtaggcaggggtcagatcagaaagaacttcataggcagtggggaggacactggattcattctaaatgtgctaaaaaagccatggcagggaggcatttgggcaggaggtgaaatgatctgatttttattttaagttgataattccagatattgtgcagaggtggagaatggattgtgttagagatgggtcagaggcgtgtgttagagatgggttagagatgggccagtcaagaggtcaccatcttccaaggtcagtgatgatgatggcttggactaggagaatgaatgagtgtgttgagacatacttgaaaaattgctgcattttcaagttggagctgacaggatatgctgatggtttgactatgggtgtgagagacagaactagtcaaggataactccaagtgttttggcctgagtaataggatgcatgttggttcaatttccagtgtagggaaaactgtgggagaaacaggttgagggaataatgagttccgtgtcagacatggtacgtttgagatgtccattagctgtccaaatggaggcatttacgatgagattgggactggagctattggcatttagaacttcagcattgaatgaaatcacctggggagtgagaggtctcaggattgcaccttggtgccctctaacacatagaggtcagaaagaagggaggatatagcagggagagtgagctgcctgtgaggtaggcagaaaaccagtaaagagtgttgtcttcgaagccaaattaaaaacaaacaaacaaaaagatttctaacaggaaggagtgaccagctattttatatgagagaaagcattcagcaaatggaaactgagaattggtcattggatttggccagatggaggtcattgggaacatcaacgacgagattttataatattcctgggagacaggggaaggatgagagccctggtggaaggggaatcaaggcagaaagaaggcaaggaattgaagatggtgcaaacaggtaagtctctggaccaaaataggcatgacccagttgaggggagaaattgcaggagcaaagcccaccatggtgaaaggaatgtctagggcctgaatacaagtacagtccaaattttttggggcctgagctaatgcaatttgaagtcctctttaagaaaaaagaatacaaagttatacattcaaaaattaggcatagaattgaatatttatttagtacaagaagagaaatcatgacaaatcgacagcactttaaagatgcgtgtatctttcttctgaaacctctttaagctaggatttcttaacctctgcaacactggcatttcgggtcggataatcctttgtaggggactgtcccacgcgtgataggatttagcagcacccctgtcatctacccactaggtgccagtagcacctcccaaatcatgacaaccaaaaatgtttccagacatcgcccaccactaccttaaaaaccattgctttaggttatttacttgacacgcttacatacaaacgttcctgattacaacccccatctttaacattctgcaatcctcagtaaccttcagcactggctggggccggaagtggaggatcctgaagctgaggcttctggtaaatccacctttgcctgagttgagggactggactcaaacagacacaggaagagtgcccatcataaaagaaaaaaaaaccagaaaagaagggtttggatgccagtagttaatagacttgattcttctcattacttatattttctcagtgcaataaaaagcaaggatatctgttaagagggtgacagtgggaggctgttggagttttgcatggagagaagggatgaaatagtcattctgcaaagtaagagtgagcggactgggattcttacgaatcctgctagaagtagggtagagcgagaccagtctgagcagctcaaagacggcttgagcactttataaagcagcatctgccttatcaccagaggtacctgccttataacaggtattcaagtagcaatggaaagtcagaccaaatgatcctactagtccttcttcttcttttgtgattctgtgatttttatagcaaagcaacctgatggcctccagtatatcagacaaaattattccatagcatcttcattcgcaagcgagtaagatccatcccacgaaataatgatcctgatggctaagagtgcatgcccaggataagagctttccatgctttatcttatttaatcatactcacagcatgggaagaaagtttaagaaagatcaagacgcttatccattgacacacagctggtaaaaattatattacccagattgaggaacattctacaaaatgcctgaccagttttacttaaaactctcaaggtcatgacaaacaaatgaagactgaaaaactgtctctggccagaaaaaaactaagaagacataataagtaaaagtaattatagtatcttggattggactctggaacagaaagaggatattagtggaaaaactggtgaaattcaaataaggtctggaatttaattaattgtacagcaccaatgctggtttcttagtttttacaactgtatcatggtaaagtaagttgttaacattaaaagaaaataggtggtttatgcgcggtggctcacgcttgtaatcccagcactttgggaggccgaggcaggcggatcacgaggtcaggagatcgagaacatcctggctaacacggtgaaaccccgtcctactaaaaatacaaaaaagttagccaggcgtggtggcaggcgcctgttgtctgggaggctgaggcaggagaatgacgtgaacccagtggggagcttgcagtgagccaagattgcgccactgcactccagcctgggcagcagagggaaactccacctcaaacaaacaaacaaacaaacaaacaaaacctctgtgtattattatctctgtaatttttctataaatctaaaattagttaaaaaaaacttgcctagaaacaacaacaatgacaagtgtgtgactaactccctggcattctaactccaggaagctttgcttctctgtgatgggtcagggcactggaatctgcaggttattctcctctattcaatgtgactgtgtctaaggtctctgctttctgcttttacacctacatgtgtcctccagctgcaaggcagcctggcacagtggagagagattgctttgaatccatgcaaacattggctgaaccttagttcccctattacttaactgtgagtgtggagaaaccactttctgtctcaaacttttggcttcttgcaactgtaccatgcaacccataatatctctttcctaggcttagagtcagattccaactggcaagtgagaaaagcaaagcagttggcacccagtaggtgctcagaaaacacaaggtccgccttcttcattctcagtgctaagaaagtgggagctcacccagcctctctctttctgacaagaacttctcatgtttaatttataggctggtttaggtagttgaattttaaataattcatagccttgctgttaatatttgtagttgttgaattcctttaataaaacatttagggatttcttccccctgaagtgtatttcatccggagaatgatttgttttctgaaatctgggactcggctgccctttcgttattttcttttctgcatctaatcctgtttattgctgtggcagaggtaagagatgcaagcttgggttttgctttgcatgggtatgcaggcagggatgtcaattcatctgtggctggggctcgtgaggtgggttcactctaagtgggggtaccatggcggttaagaacatcaacttcatactgtattaggtttgaactcaggcctgcacttccttcttccttgctgtgagatctcatccaggtaattattattattattttgagatggagtctcactctgtcgcccaggctggagtgcagtggtgtgatctcggctcggctcacggcaacctctgcctcctgggtttaagtgattctcctgcctcagcctcccaggtagctgggactcctggcatgtgccacgacacatggctaatttttgcatctttagtagaaacagagtttcgccatattgggcaggctggttttgaactcctgacctcaagtgatccacccacttcagcctcccaaactgctggaactacaggcatgagcaaccacacctggccttatccaggtaacttaacatttctgagcctttggtttctcatatgcaaaataagaatgagaacacactccttttactttccctgacatacctctggatttcaaaattctgcttatatccatggaggctgctttttctaatctctctcagcctcaacccccacttagtgcatttgatgtggcaaatagactcccttattaattctgttttctcatcaccttggcttgagccatttccacaagaactccaggctctttcctgattcccatgaaaccccgctggctttgtcatttcttagtacccctgggtttgagggaaggggaaggatgatttgggcatgctgcagccttttctaaaaggaggctccagctccctcttgaagatgcagaaggatctgaaatgcaaggcaagcttcacaggtgccaactgtattgttcaaagaatatactcccttttatagcacttatatttcattctctactgccagaatggagacacatgctgggtttctgcattcgtaattggggaagaacagatgggagagacgcagttggaagtaatactgtcattaaagtaatctatactgctcctaactctcaggcatgtgtgagaaggtgagtggagccacatggaccaagttcctttctgttcagtcctcatggaaattatggggtggcacatgactttggaagaatcagaaaattcacattcacttatggtattcctctgtgagtatgtttctagctccagagcctcaaagacaagaaaaggaacagattgatgatagtttccttaggtaaggagtggagtaggcattctagatagagagaacagcatatgcagaggtgtggagcctggaaataggaaatgttttaagtaatagtaagtagagaagctgagctggtcttgttagggaagcagcagaggatatggctagaagaactcgtgctatggggacgaggttcttgaataccaggaaagaagctgaaggagagttgctgtggcatggcagagcaaaggctgcaatcaggttcagtgcaggctgttactgactagctatgtgaacatgagaaagacacttctcttttctgggccccagtgcttcatctgcaaaatgggaatagaataaatggtctaaatagaacttcagtggcttgaaggacaacagctctgaacttcaggagaatgcatctaattcctgagtcttttggtcatgtaagtcaattctaagctgagcatatcccagtccttgttgactgagtaataataataataacagcatttgtaaaataatagagtgaccctttgctgaggtcctactctgtgccagacactgtaaagtgttttattattattattattattattatttatatatatttttttttacaatctcaatctcagtcttcatgaggtggtcctgagaagcccactgtacagatcttcacatctgaggctcagatagggaagaggataggaatttatgccacccaaccctgggtggcaggaccaagaattatgccagatgtcactggcagctgccacagcagtaatggcacctcctaaggcagagcactctggagaggtttaatgttcgctggctaatttaatccctcccactgcacctcaaagtggatcctgggatccccattttgtagatgagctaactaaggctctgtgagaagcaatcaccagctcaaagtcataaaaccagtaaaggctgaagctgagctctggcctcaggtctgcctggtattcaacctccagatgctgccttaggatacttcagccttcaaattcacacaggaggagcccaggattagtgggcagctccacagccccttctcccaaaatgtgagatgttctttgcaaacttttcttagggatgcctcattttgacagaacacactgccctctcttgccctggggagcagtccccattaagatatgtcaatgccattgaatacaaagcaaatatctgggctgatatcttaacatgtctgtagcagtgactctagactccctaaaagaccaaaaagttctcatggccatggtcatggacaaacttcttgggaagaggcttttgcagactagcacatcagcacaaggtctcaaagttgacttttcactgtttactcctgaggaggtgtggacataataagaactatgtatttggcctctgcctcaagttcctgacatagagctcccaaaacccttgtaatgtcctgactggtaagagcatattttgttttaatgaggtgattcttggtgggatcctggatagcttcaggatgggagctggtcaccagaaagggcaagccatgattagaaacttggaactttcagcctcaactccccattatctgggaagagaagaggagctggagagttaatcacgtcaatcttggctacatgatgaagcctccataaaaatccttaagctgcagggcctgaagagtatctgagttggtggatgcatccatgtgcctggagggtggtgcaccccaattgcatggggacagaagctcctgcacttgggatttttctggacctcacgctatgtacttcttcatctgtctgttcatctgcatcctttagaataaaccagtaaaaatcaaagtaaatatttccctgagttttgtgacctgttctgacaaattattgaacctggatggggagtgaggtggaaagtggcttgcagtggggttatgggtacccctgaatttgtagccaagtcagagggaactgtgaggatacttgtgtcaggtgtctgaagtgagggcagtcttctgggactaagatttcaaacccacatggagtttttgtcagaactgaattaaattgcaggacacttagctggtgtccagagagttagaaaactggttggtgtggggaaaacaatccctacatttggtgttggaagtgtggtgagtcaagatgcaggttttcctctagaatgtagccttatttccacatgttggggtttcatgttgttgtctgtccctgaccatgaatggcccaccatcagtgaaaagtgttgagccgtcaaagcaagatcacatctcctcagacacccaaagtcttgtggtaggaaggctgggagagagagtgaaaattcacagagtagcaactttgtccaaattagctcagaaatgtctcatcacagccatgaaagatggttactatatgattgtttccatcttacaggtgaggaaaataagctcagaaaggtgtaaacagcttgcccaagatcagtgttaagtgatagaggcaaaattttaaattcaagtctttggccgtctgacaccaacacctggaccctttggcctacattccatttcctcctatagtagaaagatgtgggccaggtgtggtggctcatgcctgtaatcccaccactttgggaggccaaggtgggcagattgcttgagctcaggagtttgagaccagcaacaaagtgagacccgtctctacaaaaattactaaaattaactaggtgtggtggtgtgtgcctgtggccccagctacttgggaggctgagattgcttgagcctgggaggcagaggtcgcagtgagccaagattgtgccactgaactccagcctgggtgacagggtgagacccagtctcaaaaaaacaaaaacaaaaacaaaaacaaaaccaatatgaatgtagttggtcttccctttctcacttctatccccatctttcccattgatccaagattctataagagtttaagaaatgttattgttccagccattggggctggaaaaaccctctatggagattttttttttctcccctcattattttgcttaagtgacagggaagtcttgtggactcctgtggattgcaaagaccccattcatattcatcacattcttactgcacacagtctgtgcatgttgttccttctgccccaagagctttttctcacctcctttccctttactcctgctcatcctgtagatgttagatcaactgtgactttctcaaaaaagctgtccaaccctctccataggtcccttgatcccagtgaactctcataacattgcactactttcctccctggcacatagctcagtttgcaagtattaataattggtgagtttttgagttaatgtcagccccaccccccaactagaccataagctctaagagggcagggtccatgtctacttggatcatgattgagccccccgttccatgcacagggcttagattactatagatgacccatcaatgtttactgagtgaataaacaaatgcgttaaagcataggacgtaaaaacttttgggtctggagacaatagaatttctgaacttgtgtcttaaagaggaatagctttttcctcataacttgttagaaatgcagaatcccaggcctcatcccaaaccctctacataagaatctgcaacttgccatgttctggtccccagaggattcctatgtacattaatgacttataaatactgcagaggagaaaaagttggaatggaaaggtgaagtagcctgtgttaattaattgatcatgtaattggttaattataaaagtttgtaaaattattctgagcaccttctatggatctggtactgtgttaggccctgggactctggcatgaacatgggagatatggtactagcctcaagatagtgcctgatatggtttggctgtgtcaccacctaaatctgaacttgaattgtatctcctagaattcctatgtgttgtgggagggacccagggggagataattgaatcatgggggctggtctttcccatgctattctcatgatagtgaataagtctcacgagatctgatgggtttatcaggggtttccgcttttgcttcttcctcattttctcttgccgccaccatgtaagaagagcctttcacctcccatcatgattctgatgcctccccagccatgtggaactgtaagtccaattaaacctctttttcttcccagccttgtgtatgtctttatcagtagcatatatatggactgatacagtaccccatacctgtgtggatgggcaaagcacccagagctagcagagtagagggagaggctgctcattgagcaggaaacagggagggctttctgcaggtgactagcagtggagggcacagggggcagcctcatagacaatgaaatttcctgtcctgtgtcacagtcttgaggctgggggatggagtcagcaggttgttgtaataatccagactagaaatgtaaacaggtcaccattctttctctcccagctcttccctgaattctcatgccattctgaaaaacctgcctaaaaccctttatgaatcagataagggccagattccataggcttctttcaaacttttttttcatattttttcatttacattctgcctctaaatgtcaatcttctaccttcttttctctctctgtgtttccctcctttccactgtttgccttgctagtgtccctctggcatctccattacacggactattatgcagctatcagaaatgatgtttacaaagactgtgtaataaacatggaacatgcttaggtttaataggaagctggtgcagagttgtatagacatatgattacagtcttataaacataagtctatatagttaacaaaattttaaaaagcaaactccagagtgagtcaaacaatatttatatgtgcctggggtttaaaaatatatatatttgagatgtttattttctatctttttatgactagggatttctttttacataataaataaaaaccacaaatttaaaattgttgctatttattcactgtatcattttgggcttttttttttaaacttccctgagcctcagttttctcatctctaaaagggagctgacagttgggcttcccacagaggatgttttgcgattgtactcaccaagtgtgctatggcacagagcctggcatgagagtaaaacctaaccccatagcagtaattatcatgtgaggatcagttcccagcttacctgattggtatagattgaatcaaaaacaagaagtttgatgtggtagggatggaggtggagggcaaggagttatccatttggaagtcctgattttgtggctatgtttgcccctaattgttgtgcgaccttggcaattcttcccatctctgggcttttgtctctccaaatgtagaagagaaatggaacctcaaagatcaacataatttcctcttacatgtctaaaagataatacctcaatttccttgggaacacactgtgaacgttttaacaatcctaaatattctactggacaaatactgcagcctctttctaatgtcccttaactccctgagtttcatggacctatgaatttttcatccttgcttcttaaaaacaacaaggtccctcctcctctgatgaccacagaacaattcttggttgtgtcaattgtttacaaaaacatcatttttttttttttttttttttttagctgagagcagtagctcacacctgtaatcagccctttaggaggctgaggcaggtggattgcttgatcccaggagtttgagactagcctgggctacatggcaaaaccccatctccactaaaaatacaaaaattagccaagcttgatggtggtctatagtcccatcctctttggaggctgcagtgggaggattgcttgagcccaggaggtgaaggctgcagtgagctgagatcacaccactgcactccagcctgggtgacagagcgagaatctgtctcaaaaaaaaaaaaaaaagtaattttttaatattaggaattagagtgtggtggtcatcagttcatggctgacagaaacagcacttcctgctctttgcaatttagttcttataatggacaagtcttgtttcaaatgctgcctccttggtattctgtgtacaatggaaatgggggttggattagatgctctctaaagatggtctgagctctaaaagttttcttcctggacagcagcagtttccctggataaaggacctttttcctgagcatgtggctctgtctcagaagcagcccctctccctggttccccagtagagcttccaggctcagatgagtagggccagctggctttgctctacatagaggccctaaataattttagtggcttaaaagcagaagaatggttctccagctcctgtaagaggcagaattaacagagaataacttaaagggaacagcatgaaagaggccaatggaaagatagaaataaaatgaagaatgggggcaaccaactttcagggtctctcaaaaaaaatcctgggtcaggatcccacctgtctactgcaagctcccttcttcctgctcacagtgccttcttgccttaatagtacaaagaaaaatgctttaccatgatttaggtactatgctaagctcttgaccatacatgcatcatttaaccctcagttacaatgttggctccatgagggcagggggattttgtctgatttgtttacagttgcatcccattttctagaacaataccaggaccccggtatgtgttcactgagtatttggtgaaatgatgaatgatgacttgctgaggtcactacgattactaactccattttacagatgaatacactgaagctcctagaggttaagttacctgctcaagacaacgtagctagtaggagcaaagccaggattcaagtctagctgatcttaaagcctgctttattttagactatgtcctcacaggaaatatccatctgttttagtctattctcacactgttacaatgaaatacctgagactgagtaatgtataaagaaaagaggttgaactagctcaccgttctacaggctttataggaagtatggccacatctgcttctggggaggcctcagggagtttctactcatggtggaagcaaagtgggagcatacatctgacatggtaggagcaggaccatgagagagatgggggaggtaccacacacttttagacaacaagatctcacaagaattcactatcatgatgacagtatcaagggggatgctcttaaaccatgagaaacagccaccatgatccaatcaccttccaccagacctgcatgagcctgttctcacactgctataaagaactacctggctgggcgtggtggctcacgcctgtaattccagcactttgggaggctgaggcgggcggatcacatggtcaggagattgagacaatactgactaacacggtgaaactctgtctgtactaaaaatacaaaaaattagccaggtgtggtggaggtcgcctgtagtcccagctgctccggaggctgaggcaggagaatggtgtgaacctgggaagcggagcttgcagtgagccgagattggaccactgtactccagcctgggcgaccgagcgagactccgtctaaaaaaaaaaaaaaaaaaaagaactacccaagactgggtaatttataaacaaaggaggtttaattgacttacagttctgcatggctggagaggcctcaggaaacttacaatcgtgttggaaggggaagcaggcaccttcttcacaaggtgtcagaaaagacacagtgagaaaggagggaggaactggctaaacacttatctgatcttgtgagaactcactcaccattatgagaacagtatgggggaaaccacccccattatccaataaccttccactgggtccctctcttgacacatggggattatgggaattaaaattcaagatgagatttgggtggggacacagccaaaccatatcagggccccacatccagctctggatattacaactgaacatgggatttgggtggcaatacaaatccaaaccatatcaccatctcctacttctctattcacatctccttcctctctcacagaagttcctctgccctagaacctcttccttccggaagtcttttcttactacttcctttgaaggtgggactcctcttggaatgacataactacaaccctcctatgcattactaagtcaaaagctatcttccccagaaagggcacttgttattttccctaagctatgcctgaatactttataccttgaattattattgttcataaacatgtgtacccataacaaattataagcttttcaaggaaggccctgtgtttggttatgattaattttatatattgctacaatgccagattcataatgagtttttaatcatttttttcaataatgactcatttaagccttggaatcatagactcagggggcaatttaggtgtgcctatcaaaatgtcaaatatttttacactttaacatataattccatttgaaaatacttaaaaatactaaaacctagtcacaaaaatgcatgcacaagtctgtgtattgttgcattgtttgtaatagtaaaaacatgtgataatgtaaaagtccattactggctggtggtgaaatgaatcatgatacatctgtgttatggaatattaatgagctgtgaaaaagaatattgtagatctggatgaattgatatggagacatctttaaaacttcgtattagtagaaaaagcaagtttcacaaaaacattcagtgtgatcccaatcagattaaaatttacctatgtaaattcatgtcaacagttctggggataagcatatcaaactgctaagaaatatgtactttggggtgggctggaagtttggagactgaaagagatttctgcctttttattctgaaaatacttcttaaaaaatggtggcttaaaacaatagactcacaggacatgaagattggaaggggccttatagggcagaggtggtgcagaaccttccacaggcagtattaggttctttgcatatatttcttacctatatctcataacaaaccccaacaggtaaggttcaacaatgccactttacaaacaaggacattaaggttcagactcaaacaaagcccgcctaaatctcaaccttgtccccttctttccaaggttataacagtacaattctaaccaaaattttattttttagataggactttgagacctgttcaggctcagccagaagtctggaagtccttcctgtgctgtctcttctaatcacttctaacatctggaggttatcaccacagccagccaatttgttcactgaaggacagaagctttgcattctgtttcttcgcccccaggtttgggttgatcatggtaccagatgctccttaaccctacaatgagatagtcactcttggaggggccaagtcagctattagacggcttctcttgatgcccttgtctttacagttgtcctggaaaaaccagacttctgccttaggcagagtggttccatttgaagttatgagaaaaggtgagtgaggagtagatagctatacaaaactattttgtgatatgacttggtgttctttgatgaggcttggcagagacgtacaccaactttcctcagcttttacccctggagatggagatttctttagggactcagatgagtggttgttctgcattagggctgggaaaatctcaaaaagagctggagggtggaaatgaagaattcaacttggaatccttaaatctcagacttggaagaaagctcagcagaggagatttaatctaacttctgacccatgcaagggttctctctggagtgtccacatagagcacaccttgctccagtgccagggaactcaccacttcagtgttgaacaggtcttactaagagaaggcacttgctgatggtgcctagatctgtctctccagaagccatctcccatgtgctgtggagcagggccctgaggtgaaggcactggaagcttctcctcttgttactggaaaggggtcccaatccagaacccaatagagggttcttggatcttgcacaaggaagaatttaaggtgaatccgtaaagcaaagtgaaagcacgtttattaggaaagtaaaggaataaaaaatggctactccaggctaggcacagtggctcaagcctataatcccagcactttgggaggctgaggcaggaggatcacctggggtcaggagttcggaaccagcctggccaacatggtgaaatcctatctctactaaaaatataaaaaaaaaaaaaaaaaaaaaaaaacttagctgagtgtggtggcacgatcctgtaatcccagctactcaggtggctgaggcaggagacttgcttgaacccaggaggcagaggttacagtgagtagagattgcaccactgaactccagcctgggtgacagagcaagacttcatctcaaaaaaaaaaaaaaaaaaaaaagaatggctactccattggcagcggtggcatgggctgctcagcttcttatacttattgttacttctttattaattatatgctaaacaaagggtaggttattcatgaattttccgggaaaggggcaggcaattcctggaactgagggttcatcccctttttagaccatataaggtaactttctgacgttgccatggcatttgtaaacagtcatggtgctggtgggagtgcctcttaggatgctaattcattataattagcatataatgagcagtgaggatgaccagaggtcacttttgtggccatcttggttttggtgggatttggatagcttctttactgcaacctgttttattagcaaggtctttatgacctggatcttgtgctgacctcctatctcatcctgtgactaagaacgccttaaccttctgggagtgcagcccaataggtctcagcctcattttgcccagccccgactcaagatgaagtcactgtggttcaaatcttctaacactctgactagtatacgacttccaaacaagtcactcttgccacttaggagatctgagctgagaaccctcagaatcaaatcccttattttacagttgggaaaaatgaggtccagagagccaatattttattaatatctaagtctcatatacccatatttgctttcttaatataaaagaatcatttcctgtcttacagttaacaaaatatcagatattttagtacactctgctcagagctacagcccctgcttagtcatcagcactaccaccactaccatcatcatattaataattattcagtgtctcctatgtgctaggcattctattaagtgttttacattgaatgatacctcttgagaaccttatgaggaggagtgaggagtctcccagttagagaaggaatgcccacctatcatgatagtcatttttcaagtagctgtgtaatggggcagaagatgagcttcttcctgctagatttcatcacctggggcttgtagtctcagaacaacagacaagtcaggctccttttccagtgcctggaaggacatgcagatgtatgtgtgtacacacatactcacatgtactcatacaggctctctgctacacagatacgataaaggaagcttgggtctgtctctgggaaccactctcttattaggcattacctgcagttcctgagtacttcttccagtttctcagacaaatctaaatagaaaccctgctactcctatttttccatgtgtggggggtggggggatgaacatattgtaggctgtgattaataatttaaaaaattattaagaaagatcaagcttcctgatgttcagcttagaccatatgtacctcaccttccctgaactatccctgtcctgcccccatatgcaaggagatacacaacacaacacacacacacacacacacacacacacatatatacacatgcacacatgcacatagggatgctcatacattcaaaaacatccagtgttccttcactgcctgtaaggtaaagctgaaacactgtagcctgaacatatgaccctttatgatttaaattccatcctttcttctgaaactttcttcctccattccttatcatgctccatccaaactggtctactgtgcatgccatcccatcctggcctcccagaaagctctttctcaggtggtgcccctgtttgtaatgttgttccctgtatgatcaccaagaccaagttcaaatactacagtgtctaagaaaccatcaatgatgtcttcaagcttcctgctgtaacctctttctcatcagagctcttaaaatcattttcaaaactgcttcaaaaacatattgatttcaataatttatgcagttcccttaatcgttgccaccccctgccactgcaagttagagctttctttttggtgcatagatctctttggtgctatatcttctatagccttgccagcttcatctgctcttgtagaaacttctctgctctttcctccttctttttggtccctgccttcatgttatcgagttccatttcaacctctttaccttgataaaacacatgtacataattttggcattgctattgtttttcactggagttacaagagatgtttgaccaatgctcataataatacatctagccatgctgataataatttaaatatggcatttaattactaagctccaggcactatcttatggaccttatatactttgcttcatttaagtcttttccaggatcgtgagtgggtaactcttttaaaattcctattttacagatgagaaaactgataactgaataagttaactcaaggtcatccacagagtgacacggctgagatttgaactcatgtgtagctgactccaaaacccaagttcttaatcactttatcagaaaattaccaaaaggcatctaattagttgcatgcaattaaatatatatgagggagagggccatcaggagattatttagaaatagaaacaaaataagatgtatgaaaacaaagataaaagcaagaacagttgaacagagtctgagaacaatgaatcgtggtttacaagttttagaaaaactaattagctggaatatagcaaagaggtcagctctgagacatctatccttgagaaggctaaggaggagtaccaaagaaacccattttcattgcagattgcagaaaaccttgagcgtttcactgaggaatgtatgtggcagggtatctctgttgccttccatccatacctctgcttttattggggtggtctccaccacctccctcatcagaacctctccctagggtgcatggcttctgatctcccaaaagactggtttctactgttaaaggagatcgtgcatgtggagtccttaacaggtgagacagtcacatggccatcctgaaataaatgtagagccatgataagccttataatcacggggtgtcttgttttcatatatttatcattactaacaggaagctggtgggttttgctttcctggcttttgctggtgttgagattccttttttaaccagctctggtaactcccttatgtaacaacacatgcataagtattcacacaattcactgctttggattgatcagctctatctatgagaattgtcttggccacagtgaatggattatagttacaatagaagtctgtactaggtggtccttcttttgacacttgcggactcccaaggaatggtggctggactctattaggctccaaactctcatgtgcctgagcgccagctccctctctaaacataagcatctcggggctggaggtggggggaaattttctgatgcatctttctttgccatgtaattcctaccccaggatcatgctcacataagtgttcttggaatatgtgagtaagtgactgaaaactccattgtactgccctgttgctgcataaaactggttgtcaatgccgacagctccctgtggtgtttttcttccctttgggaaatcacaccaatttagctttggctactgttccctccgtataccctttcatgtgtatgcaacaacccacagtatctcctccttgctttcaacttgctagagaccagcctttctcatgacactccacagcttgactcagcttccctccctgttgctatccctgatctcccaactgcctccctcttccaaattatgtgaaaacaacgaccatttactcaatacctactacctggcagatgccgtatgtgaaaaacctttctgggtcctcataacagcccccagggtaggtctaccagtgtctattttacacatgaaaaaactgaggcacagagaagggactttggaagcctcagagaaacagctgaaatgccagtcagctgtgattgacaccaaagtccagcaatttaaccattacagtataatatatctttaaatagaaattccaattacatttttcagatattctaaaaaaattccacatatagatttgaagactaatgggcagtcatacacccctgagctcatgtttactcagaaatctttgtcgtaacagctgttcctcccctaaccttgtatgtacttccagtttctgcagcagatactcaagcctaccacgtgcaagggagattgctgggcactgctttggagcaaagtgtaatatgttataaatcatacactccatgagtttacaaaagaacagagaaatgaaggggaagaaagaaataaaagaaaactgtattaaaagagttgattattagaaaatgcttagaaaggcaaagacttgtggaggtacaaaggaatttgtcaggtacagggtaaaaaaaaaaaaggatgtttacctagctgacctgtaagttaaacactgtattaagggcgttcatagcaacagtggccattttaaagcatctattatgtactatgagttttttatgcatttttcatcccttcacaagaagtgaacaaaataggaattctgatctctattttacaaaggaagacactggaagcacagagaggtgaaaaaaatcacttaagtgtacacagccattaaatggcagaatcaaaataagaatccaggcctgtcgtggcctgcatttctggcattcctcacatacgcctcccagtgggatccagcatattatccccatttacaggtaaagaggaagtggcagaatgtcagtgttggaaaggacttgggaactagaatgcttgtttaggggaaacaaggaaggctgtgtgcagatgtgctggacctggaaggactaataggacttagtacacagacactgtaaaagcattcttgagagaaaggtcttcatgagaagaggcggaagtgtggcagatgcaggacgaaaagaagatgccactgactagtgtagcagcacttttaggctgctggaagctgacatggctggaatcctaagtcaggcctagctacaatgcattcctttggtatagattatttgctttgaatcaagggtattgatgctgcagagtcaattctgcaggaagtgaaccctaaggagaggcactgagactttttttgggagatcctaaaaaagccagttcacctgctccaaccacgaggcacatttgctcccaaacattgactctgtgctgcatcttggaatattttgcacgtatctctccctaacctggagaaatacagtccatggtgcctttgggaaacaaaatagcacttcttccccactatctcatctaaacaaccctttgctgactaattgaattactctggcccacaaactgatagacagctgctaaaaatggttattgcattattaattcgctccagcaatttcacattaaacctatactgttaataatttttccccttctatttcttccctcttaattagactatttaaaactttgaaggaatagtctttccatgctaaatggaggcatcgggcaaattacatttttgattgaatacttctctgataggccagcaaatgagactgttgagttgttaattattgtcagagttccacacgacacctgctaatgaggcagtcaatctcagctgtcagtcccctgatactaatggaggctgatgggatgtactgggaaggatgcttgctggaggtccagggtgtccagttccctggctgtaaatgcaaggccagtgacttcccaattgctaaagcaaatgggaaactgtgatgagtggggaaggggatgggcagtggaacagaggtgaggacagccaggtgaggagagcaccaggtgggcaccattgggatggaccactttgttgttgttcagtaaatactgctggtatttttaatcattgctgatagggctgtgtgtctgcagtttcttggaaggtgatggatataaggaggtgcctattgagcagtcagaagacttcttaagacccctgacctggactctgaatgacctagccccaggctccagaagatgttttgaattttcttccttatgtaaccagggttatgctggtgtggactgagagaggtgtcaagtctcattcagcaagactgggagtgaaaaaaaggggatggcacccaagattgggtacccaagaactctatatactttttaagcagggttatgctataactctatatacttctgagcagggttatgctggtgtggattgagagaggtgtccgatttcattcagcaagactcggggtgacaaagaggggatggcatcaaagattgggcacttgggaactctatatttagtctgggacaaagcaaaagctcagtagaagggcagggaagggagaaaaattggatttgactaataaatatttactgagtactttgtatgcatgataaagacttaagttgtctgtgcaaactcccaaggcagacattttttgggaatcatccttgacctttacagcgtctacttcacaactacccacttcccccgcccctccattagattgcttcctgaggctcatggattctccttcaccaatgcttcggaaactcattatcttctccctctcaatttttcctcctccaggcccagtccttcccatcaacttctgggttactgaccccaatctaattattgctgaatctacacctcccaccctctgccaagtgacatcttcgacctcatctcctactactcgccccagcttatgcagctctccaacatgccacgtacactcccctgctctcctctgagcttttgtttcaccatctctagaacagggcatcaacctgctgtgacgtacctggcagggttctgatcaacacacactggcttccttctccttgagcctttatcgctaagcctcatcattcaaactgatctttatgctttcctgccatcggcctatcccttcgagcctattcattttattatggtggagacatgggttgtgggtggggatggggaggttggcaaggaaaggctagaacatccctgtcacaggtgcgagtcactgccccacagggagacttccctctcatgggggaagacatgaaggcagacccctaacttgggaggggcatcaggcaacaaattattgaattcttatgagttttaaggcagattcttaggttttactttgcaactttgtgggggaatatagttaactacattgagcaaaagattttaacttctgaagatataatctggccactttgttaactgcacatcgatgccacaagtgattgttgacagattgcaaggtactggacactgtcttaggagctaagatatcataggtgtcaaagcaggcaggatctctgcccatcaagagcatatattctaatttgggaagcaaagggccaacgagtaagcaagtaaatgttcgataatactaagacatacaaatatcacatctcttgtgtaattatgaggcatgggagtgatggtggtgtggggttgagtaatttcaggaaaatattaagaggtagatttgagctgagatcttaatgaagagaaatccaggtaaatgaacgtaggggtagagagagtaagcatccaggcagtggcaatagcaatcacaaagggatggagaagaatatgagcttggatagttgcagggtcagaaataacgctggtttggctgaactgtgagaatgaggggtggtagggggaaggggtagtagagtgtgagtttgaagagataggaccttagaggccatggtaacacacttgaatatgatgccaaggccaatgggaagctgctgtgagtttaaagcaggggcatgacatgattggatgcaggtgctttctgaagattactatggagcacctcttatatgtgaagcccggtgccaggtggtggatgcacaatgatgaagtagatacagacatcaccttcttagagtgccatctaacaatggagacagacacacagccaggtatctgatgcaatacaaggacaaacagcctggtagtggaccctaatggctgctctttcctctgatagtaatagacaatttcattgggtttttggcttccacatttcctaactttccctgaagctgggtgtggctgtgagattacactgtggctaacaggatatatgtggaagtaagtgatagcagctccaggtttcctccttcagaggcagctggttctacattctgctgctcttccccctgcttccatcctactgcttcaaatgtggatgggagagttacatgcatgtgccctggaacaccccatgagagctagacatcagggacgcaggaacagaaagctacaggaacctggagttctgcatggagcactccatgcaggagccattcagttctgcatggacacagtaaagagctgcaattccaggccgggcatggtggctcacacctgtacttccagcactttgagaggccacggcgggtggatcacttgaggtaaggagttcgagaccatcctggccaacatggcgaaaccccgtctctactaaaaatccaaaaattagctgggcatggtggcacgcacctataatcccagctactccagaggctgaggcaggagaatcacttgaaaccaggaggtggagttttcagggagccaagattgagccactgcactccagcctgggtgacagagcgagactctgtctcaaaaaaaaaaaaaaaaaaaaaaaagagctacaatttcagtcctaggttgttacttctgtacttttacccaaaagacaaatctccatctcatgtagaagcaggctctattttgggtctatgctattgtagactaatttaatcctaagagttagctgtactaataaagtgttggcaggagagggattttttacagacattcaaaaagaaaggaactaactccagcttccttaaaacaaatcgagcacccctcctggattcttcttattacctactcttcatacctcccagtcaatgctgtaaaattggttgagactggctttctctgagaactctggatgctgatgttttttgttttcttgtcttccctctagtctacttcaagcagacagaaggggagccggagtgaaggtgagtatgaggcagtcccttcccgcagagaagtctggagattctgcctcatgtttatgagaaaggcaagccaagacaagtttggatgggaaacaggagcacttaaggaattaaactacagcattcatttcacaagagggggaaaagatggagaggaaaacagaatctaacaaaatggagatggcaacccctttaaagctattacttattggcaaggattgttcctgaattttattaaggaaaaaaaaaaggcaatgaaaattcagcatttactaaaacactaccatttaaatggaataggaagaacataccaattatgctggaacccacatgagtctgtacaggatgctacaccaggcaaaaacaaaaaacaaaaacaatactgacaggatgatgtggatggcctgtctgactgttctggactgctctgtcttctggctaaataatgtcttcaggcagagataacaataaaaaaatttaatacttggtaaatggagggtaccaccaatcagccaatctgaatatggtggggccctggagacctcagttgtgcgaagtgttagtcctttttttttttttttttttttttctggatcaagggcaggtctggggagtaactagcagagggatggaggtgatcagggcacttgggggctcaggcagcagctatttaaaaaccaatccagatgcaattcaatattttaacaaaaccacacagtgtgctgttgtatatttgccgaatatcatcagctccatttccacaaatgagaagctactgctccaaagaggtgcctcgatgccttggatcaaagaagcccgatttcttttctcaacagtcacagaggtgccaatgttctgcaaattttcttccaagccccctaatgagcccaggagtccccatcaggagcaatgccagctgcaactaatgcacacaaaacactttgcaattaacagagtcgagtgtgtcattaagacaaccttatgaggaagacaatactcccaagtaagcccggaagcataatgaagctaggaggctagtatacacctaagtgatggccctatagcaaaatggcttttttgcttagcaaactaacacaggaacagaaaaccaaatacagcatgttctcacttacaagtgggagctaaatgatgagaacacatggacacatagaggggaaaaacacacactgaggcctttcagggagtggaaggtgggaggggggaagaggatcaagaaaaattactaataggtactaggcttaatacctgggtaataaaatctgtacaacaaccctccatgacatagtttacctatgtaacaaacctgtacttgtacccttgaacttaatataaaagttaaaaaaatggcttttgaattcatttagctccactgtctgaggcatggcacagacaaatgatggttgttccgtgattttctgttgatgtttatatacccccctgtccatatacagtggctgttgtagaagcaggtttggttgcctagagtcaggttgttacgtgtgtacatcccagctgttttcccgttctagatgtgcaaactcagggaatgttcttaaactctctgaacctttatttttcttacctgtaaagaggttaggggagtactatttgccctgctaggttgttgttaggagttacgcattaggagtaattacaaagggtgccaattaatggtaattcccttagcaaatcttcatgtctgtgctggttgaacatacacttctaggtctcacattttaaatgaaatagatagcagactgaattccaacaagtccatctcatggttcaatacatagaggatttgaggctgagagagtccagtgacgagaatatgggttttaaagttctatataccagaatatgagtcttatcccttctgtttaaaatagctgtgtgaccttgggcaagtaacttaacctctctgaaccttatggtctttaacataaaagtaatactgcctacgttatgggaaggttgtgagaattaagtaaagtaagctatgaacctagtatatagaagacactcagtaaatgtgagctttttaagacatttctgtatttccagaagcatgttcctctgcaagtcacaaatggactttggcatgagccagaaaagaaagaaaaaagcaaaaagcaaaaaaaagaaaaaaaaagacttccagtcacacagtctaaagcactggtcttgccatctggcagaacaggattcaaattccatttccatcctttacttgctgtgtaatagaggcaacttacgtcacctctctgtgtcagtttcctcaactgcaagataaggaagtgatactgcctgaacttgggggtatgtttacatgctccctcttgttttgagcattaactagttcatgtatttgtttagtacgatttatgtttaccatgtttcaggcaccgttatcacactttaccatctcagcccactaaatttaatctttatatgaacctttgaagtaagtactattactattcctattttacaggtgagacattgggaaagagatgttgagtaacttgcctgggtcacatggttagtgaatggcagacctgggatttgatcccactgcattctggctttggtgtcagtggtcttaattaccgagctgtggggcaactaacatcatcaccaccatcaccactaccaccaccacaccactaccactaaaaccaccaccactaccaccaccaccactgccaccaataccaccacctccatcactaccaccaacaccatcgccaccaccagtaccacaaccatcaccatcaccaccaccaccactaccaccatcaccaccaccaccaccatcaccaccaccaccactaccatcaccactaccacccaccatcaccaccaccaacattccaaccatcaccataatcagaattataaccactcccaccactacaatcacagccaccactacaaccccaggtactgccaaaccacatttattgtgtgctgatgaggtgccaagcactttacatgcatggtctcattgcattctcacaacaatcctatggggtaggttaagcaatttgcccaaggtcactcgatcagcaagtgctagtacttgcacttgacttaggtcctctggtcaccaaacccatgctcttggacactttattagattgctgaaactgcaaaaagcacccaacatgtcatcaggcacataactaacattttccagagacatttctctcttccaggaattttcaagctgtaaagtttgggttttctgacagcccttgagcacttcagtatcaatcttttcaccttgtctaatttgaagggtgaatctggtggcttcagatgacaaatgaacccacacacagcttcacctcgttctcatttaccaaaactctgcccaaggcttggcacaccttgtttatgtctttggaaaagaaaaaatgatgagcaaaggtaggtggcagagccctgtctagctccttaggggctggacaaattgttagatgtgagagcacattgatgggaaacataggactctagggccttgaatataagaggtgtgaaggacccttcattgtttgaattgtatgtgtcggatttttaatttggtttaactttataaacacaggcctggtaacttatgagaggatcctgggctcagccaatgctaggacaacaaccttgatttccccttctatccatctttcatactgagctagaataatggttctagaatggaggtctggtaattctttttccgccttaaaatgctttcatggtttcagattgccttcaggagaaagacaggacccctgaacataatctaagaggctcttcatggttgactcctgagcaaccactcacccctcagcttccttctcccacctccttccttattccctgtcaccacccatcactctagtcatccagggcaatctgcctgctcctgaacatgttagatattgcatcctcttggtcttcttctgactctcacacttccctcagatctcatttgggacttcattttcctctgggacagttcacatctgcctattctctaaacctttatttactggcactatctattatttctctaccaaggccagggacttgtattctctactgcctagcccagagtctgacacataatgagtaggccttccataaatatctattggttgaatgaataaataaatgagcatgtccaaggatcaagttcaagaactacattacttttgggggagtgggtagaaagatatgcatttgaggtttaggacaagaaaacattgcaaaaggaattgaaattaaaaaaaatcagtaattgttctctgattcctatttgaccctggtattatacataattaatttgataaatatgtgttagtttttactgaattgccaagcaacatgctgccctcatctgcagagataaatgtgacatcttttctgccttcataaagttcactgtctaacatgggaagcagatacactgaaactaagctcacaaaatatctgtcagctgtttgaagacatactgtgtaccaggccttttcatacataatttctaattttctcggcaacctttgtgagataggcattgattccatttttacagatgaggaaacaagcacgcgaggtttaagttggtaactttcctttgttcaatcatgcagtggagtgacagaaatatgaaatgacaacttcttaacacctgtggtctttctactatactaccttacttcaccctctcctgtactgtaatacactagaataccactttgcacatttgcaatcatttttatgcatgccgcctcatgtcagtgccatgaagcactgtttgcaatggtagagaaggatgctaatacaatccttggttgacaaatgggaaaactgagaccctgaaagttttggtcctatgttaatgcaaatcagaacagaatcctggtttcctgatggtggagacttttccttgttactctaaaaatacaccctccgaaatcatgcacctccagttccaaatacgtaactcctttggtccacaaggagcactgacattacctccccagggcggatcaacggcactgcccttgagctggctgctggcagtttcacaggccccctgagtcctcaacaataccccccactccaaagcagtgcttatatgaagtttgatttcaggcctttatccaattgctccccactcagctagctgaaagggccctggagatcatggccagccctttgccccatttgaggacaatgcattggcccaaaacacaacacattatctgggcttcaatatattatcacaatattgttttcttcagactgataacaattcattgctttaagtacacaggggcataattccaaaagagaattgattatctttctgagataactcttgctattaaaaaaagggaatattcccaggaagggatttcctttgccctccttgtttctctaggtcttatttccacaatttaactcaacaaacatttactttctttactatgtgccaaacactgtgttaagatttgaaaggacaaggacaaatatgaataggacacttcctattagggtacccactctgttataaaaagaaagatgtgtgaaacagtagtactaactcagaaatgctggagaacacggtggtaatcagctcaggctttgctggtgggccagtcatgggttcaaatcccggttctgtcactagctggtacaattttgggccagtgatttaacctcatagtctcaattttctcatctggcataatgaagacagtcatagtgccaacactgtggccttatttaacaatgaaatagtagctagctattagtagtagtagtagctatagtaagatacatggtagctagcacacagaaaatactcaataaaataatcacttttattataacaataaaattattgttttattatttaaataattttaactttaataaaatatttgcttttgttatttaaaaaatttattattattatcattattccaactcttctgaccctccaagagtcaccctggaggacaggcattatatgcttttcttctttgtaactccccatccttcgtgtctaccaaagggctcatcacacatttgattctcaataagatttagctgactgtattttagacagatacagctaaacagaaataaaatcatttgtgtcattcttttgtatttttttttccaaattgagctaatcacacacacatgcaaatcttgggtggcaaaaacctactatgtacaggcctgttctgagtgctagagagggaaatgaatacaataccaatgtggtctcataaagctcacagctccacagtgaagggaagcagtcagttttcacaatgactcaggtggaaaaatgataacaaatacgtcatgggctgcatgatgacgtttccgtcaaccatggacaaaatacatgatggtgaccccatagcatgacaacagagctgaaaaattcctctggcctagtaacattgtagctttcctaatgtcctagcacaatgcattactcacatgtctgtggggatgttggtgtatgcaagcctaccacactctctgttgtataaaagtatagcacatacaattatgtacagtacataatactggattatgataataaacaactatgctactggtttaagtatttattctactatacttttaattgttatttttattattttgtagagacagaggtctcactatgttgcccaggctggtttcaaactcctggcctcaagtgagcctctcgcttcagtttcccaaaacacagggaatacagttatcagccaccatgctgggcctttttattgttatttgagagtgtagtcctactacttattaaaatcagttaactgtaaaacagcctcagacaagtccttgtaactgtaagacaacctcagacaatacctccaggaggtattgcagaaaaggcattgctatcataggagatgacagctccatgtgtgttattgtccctgaagaccttccagtgggacaagatggaggtagaagacagtgatattgatgatcctgattctgtgtagtcctaagctaatgtgtgtgttcatatcttagtttttaataaaggagtttaagagtgaaaaaaactatttataaaagctcatagaatgaagatgtaaaccctcatgtacacccatatgtgtgttttaagctaagtgttactacaagtcaaaaagtttaaagaaataaaacataaagttttagtaatctaggtttattattgaagaaagaaaattttaaaataaatttagtgtagcctaagtgtacagtgtttataaagtccccagtagtatccggtaatgtcctaggccttcactttcacccactactcactcactgactcacccagaacaacttccggtcccgcaagctctactcatggtaagtgccctatacaggtagataattttaaaaaatattttaaaatttctactgtccctgttctatgtttagatatgctcagatacacaaacatttaccattgtgttaagttgcctacagtattcagtacagtaacaggctttacaggtttgaagcctaggagtaataggctacatcatgtagccttgatgtacagtaacctttaccatctatttttgtgtaagtacattctttgatgtttgcacaatgaccaaattgccagacaatgcatttctcagaacaaatccctttcgctgagtgacacatgtctgcagaagacaactgaggataccagtttgagatccattaagacttggttatggcatattgtttagcatggtatttgactctgctagtgtgcttagaattttctggtgaattatcctgggataatctgggatacttgtgattctggcctgacttttttttttttaagtcttttattctggaataattttagatttacagaagagttgcaaagatagtgcagataatttctgtacacctttcacccagcttccattcagcttaacatgttacataactatccaggaagaacagatgtcctagtttgagggctgccagcaggagaatcccctcttactcagagaagggtgagctgcttgttcttttcaagccttcaagtgattggatgagactccctaccccccacatcatggaagacaatctgctttacttaagctacagaaaaaaaaaaaaaaacaacttcacagaaacacctagaataatgcttgacaaaataattgagcatctccatgggccagtatagttgacatataaaattaaccatcacactctagtacatttatcaaatctaagcaattaatatggaaccaatactatgaacaaactacagactttctttggaggctgatcattgttttttcattacaacagccttacgcagaccaaatgacctcagtgttagataccagagttgagactattggatcagtactaccaaaaccaagcaagatagccagacgacatgagcagagaggtaggaagaacactgggccagcagactacttgaattctaatcctggctttgctactgaaaggccctgagtcctagataagctaaaaaaaaaaaaaaaagtcccttcaagctctaaaagtctatagaaatttaagagggaaagtaaaatatgtatgtgcatgcaagtgcacgtacgcacgcacgcacacacacacacacacacacacaccacacacacacacacaatgtggtcctgcttctctgaggtctctcctctacccagtgcagtgcggcaacgtgggataagattattatcactcaggccctcagatctcagtgctgataagttcagctaagcctaggccctcctccaactgcagctaaccaccgtctcagcccaccttgaacctccactgaactcaccattctgatctcccagcaagacgtggccctcttctctgatctatctctcttctctgatgcctggccttcctacctcctttagggttggtggcttctcattctttctgctggtttttatgacttggtcattggcccggggagtcctgggtgctagattgagatagccctctgtaggatatggtccctgccctgcatccagcttcaaaatgtttatcatatcaccacttgtattttaggaatatgtgcctgcaatgaaagtcctccctttcttgcacaaggtggagcactgatttgctgctcatgtgcatgtgtgcacacacacactcaacctgaaaggaacggatcgtgagggcttccctgagcaggtgtcctttctgcatataaggaagctagccagaaataagtggtgtgacatttagggaacatttctagatgactttcagatgaggaagattgaaacaataagaggccaagttcagcccaataaaagcaaggacttcagggaacaccagtcagccttagcccagaggcagcaatggcagaagagtgtgcagctgatgcacatgacctataattgccaaatgggcagtgataacttaaagcctttatattcataactctcctctttgtggtcccatttcacatcctcttctggatggttgtacactacagaaatgtcagcacatttccactgagggggtgatggcagaattagaagttattacgtgtttgagtttcttaaccatattaaatctgcacctactatgtaccaggtcttgttgccagtagttatagaccggggataaaaagatgaataaggcatgattctaaacatcaaggagctcatagactgaagggaaggggcaaatggaaaaaccatgtagtaaattgtgtataaatgctgggctctaggggtgaaggggaatgagtgaagaaaccagcactcctggcacacctgtgagtataaagatgtgaggttagtgcccacactttcagctcaggctcagagtaaagagacacagatactcattcctactgctagcacctttctttcttccctaacctgtaagactggaccccaactagcctgcttacataagtatctacaattcaacctgtaatctaaaaaagccagattcagaggttctaaaattagatattggtaatggttacacaactctgtaaatttacccaagctccttaaaaatgtacatttaaaatgggtgactgttattgtatgtacattatatctccaaaaaaagctcttaaaataaggcagattcatgttctggatgcatgtaggattgtgcagtactgcagatcaaaatcatcacggcttccctaatttccccaacataaaatccctatctttggcctgacattcaaaacactgcaagaagtaagcctcaactctgggcagtgtcttgtgccttaaatgtgctggtctcctgcatggccagcatgttccattccattgcaacgcattctgtttctttccattctatctttttccatattatcccatcccacaagattttgtttgcctctttgtttgttttaagaacttactttagcaatgcatagctctatgatgagtactaaaaatatagagatgaagaaaacaaagttctgccctccaagagttcacaggtgcacttgttcattgtgaagacggatatagaaaccgacaattacaacaataatagccaacattaatgtagtgcttaccatgtgccaggtactgttctcggtgcttttataaatatgagctcgtctcatttttataactaccttatggggaagtactattattatctccattttacaaaaaagagaactaaagcagaaaatgattaagcaaaatgcccagcgtcttaatatgagtaggtagcagagctcaaatttaaatctggggatcctgcttcctgaattcatgctcttaacctccatgtgatggagagatctacacaaatcagaggtagaaatatttcccaaggaggtgacatctcagctagttttgagagaggagatgatgagaagccatgtgccacacagacatgggagagaagatcaattaaaagcagatgcaggccaggcacggtggctcatgcctgtaatcccagcactttgggaggccgaggcaggtggattacctgaggtcaaaagtttgagaccagcctggccaacatggggaaatcctgcctctactaaaaatacaaaaattggctgggcatggtggctgcatgcctgtaatcccagctacttgggaggctgaggcaggagaatttcttgaacccaggggacggatgctgcagtgagtcgagatcatgccactgcactccagcctgggcgacagagtaagactctgtctcaaaaaaaaaaaaaaaaaaaaaagcagatgcaaagatatgaatgtacatagtagggtatgtttgggaagccataaacaatttaatgtggctgaaatgcaaaggatagggggcaatgctggttggatatgaggcttgagctgttatgaggaactggattacatcagattgaggtactgtatcagttaggatgtgtttggcctaaaagaagcagaaaagcatgaccaaaactggcttagaccataaagatatgaattgttgcttatatcagaaagtccagagatagtaaggatttcagagtcggtcaagtcatcagctcaactgtgtcatcaagatctatcctttccatctatccactctggcatgttcagcggtggtttatatctcaaaatgactccgttcaaggtctcaagaaggcaaaatattttcaagattcctagccagatgtggcaaagttcaaaatcagtgagcaactataacagtgtatccttcttaagagaaaggtgaacttttccagaagacctcctcctgtcccactggccaggactgaggatcacgtatcaactctcacaaatcactgggaaggaaaatccctatattggtttagctcttagaaagggatggggctcacctttccctgagtcacacatgcaaatggtaaacatttgcaccaaattcatgttctgtgagtaatgaaatggggactgaatgtcaggcagccagtgagaataaaactcagccttttaacctaaaggctatgaaggtagagggtagggaagggcaggataccaaagttaagacaagtccaaactgaggctgagaagcaatcttttattcatacattcattgccttttagcactctagcctacagtcacatttcttcttttcttcctttccttcctctttcattctctttatgtttctccctttctccctcccttctgccctccctcccttccttccttccactttccttctattaaacacaagtttatcaagtcccacatggtttattatttggccaatatttttcttagtgctgctggaatcacagttatgaacaacacacatagagttctggatgtcccgtgttttgtgtatcaaggagtctttgtttcccttcaacttaccccatcccacctgtattagtctgttttcacactgcaataaagaactatatgagactgggtaatttatgaagaaaagaaatttaactgactcactgttccacagaattaacagagagcataactgggaggccttaggaaacttacaatcattgcaaaaggcaaaggggaagcaaggtcctccttcgcatggtggtaggagagagagagagcacgtgtgtgcaaaggaggaagtgccacacttacaaataatcagatctcttgagaactcacttactatcatgagaacagtaagacagaagtacacactcatgattcagtcaccttccaccaggtccctccctgacacttggggattacaatttgagatgagatttgggtgaggacacagagccaaaccatatcaacacctcttcctttagaaagccttttatgaacatcccagtccccagtgatctctcccttctatcagagtttctactgtccctgaggctccccactaattcttatggagcctagtgtgaaaaaatgcagagacatcctgtggaagattctgtggacatcaaaagcatcctggaacaagggtatgcatgtttattcccccacccccaacttaaactcccctctccttctttcactgtctttttaaattctctgataacgattattggttttctgtagccaaagggcaaaattaataaattccttagctgtacaactttctcgaaatctaataatgatcactgagtgttagagctgagataaagaatgaggaccataaaatagaaacagggaaggagaaaaatccaatgagcatgctggtgtgtgaggggttgaaggggtatcaagcctgtctactccgggagtgtttttcgttaaggtcaggaatttgagcctttaagaaaaagaggaaggtctaatcttgggggcttgaggtgggaaggatgcagggcaggaaaagggtggggaggatgagagtggtaagtgctccaggatctctgtagaccaaaggattaatgtgccacctttatcttttaaggcttttccccatgccacccccaacctccataatgggaattgggactagaggattcaactagcctgagtggccacaagtacacatttttgtcaaaaaaaaaaaaaaacaacccagattgtctttaaatttctaggtgggaaaaagcaggacagagttctccaatgtgtattaagccaaagcaggttataaggagaggagaggaatgttgccaggagatatagactaacccttgatatttcttcaagggacattctacctgatgtgtattttggaaggcagtggggacttgaaaatggttttagaatctgacagttccttattttattccctgatccatcacctgttggacgtggggcatttggaagtcactcaacttctaagaaacttagtttcttactgagtgaaatgggattcacgttttctgttcattctgcctctgtggtctgttttcaagataatgaatgtgaacgtctcacagagacatctgagttaggctgatgaggttgttatttcttctgggaagatgctttttgcttcccaaagggattgcattgccaatctcactgagtaatttatgtgtaaacaactttgattttccatctcaatgactttctttttctattctctgtttcagcatatcccagatctgtatactccctcctaaaagcaagggggaataaaagttacatgcatctttttcttactcatgaggatatgcagaaggagatttctttggtccaaatttagctagcagacacacagactcattctcaaagcataaaatttggattcaggcagtatttttatagtcctggtcagaccaaggaatatttttccatgaaccattggagagtaagttgccaaccagatgccccattaatccaaacactttagtgctattttctaccaacaaaacagtctcatagataataacaatatagccatcaaaatcaggaaattaacactgattcatcactactgtgggatcctcaggttccattcaagttttgctgaatgtcctaataatgtcctttagggaaaactattcaggtcagaaccatgcgttgttttaataggtaatgtcttttagtctttaaattcagaatgtgctctcagtttttccatgtctttcataatcttgaagcttttgaccagcaacccttttcaatttgggtttatctgatgtttcttcataattaggttcaggacttacgtcttcagatggaatatcacataagtcatgattctttgatagggcattctatcaagtggtccatgattttgatttgcccatgagggtgatactcactttgttcattcaattaagatgttgtctgccagtcttccctactgtaaagtaactctttattcctttgtaattgtgaagtcctttgtggggaggtactttgaaattatgtaaatatctctttcctcatcaaacattaaatgtattcatttattagtgcatatcagtatcaaatggtggtttcttgtttactgactgggttatactatattaatataattatttattttgatgctcaacttgtaccaaatttgaccagtggcagtgtccccaagctaactcctaggtctttgaacatgtttccatacttctgacttgctttctggaacaacaagatattactggtataactttaattttccttgttgtagctttggagtcagccatttttcccaggagcactgattgtttttagtagaagtggtacttagaggccaagatctggatactacatatgctcattgctattgggtaatggagggttggggtaaggagggttgctgtccttgagccctttcagtagatagagtttgacttatatgtgtgagtgtgtgtgtgtgtgtgtgtgtgtgtgtgtgtaagagacagaaaaacagagacagagagagagagagaggagagaaataatttggtgtttttttttttttttttttttttttgagaaggagtctcactctgtcacccaggctggagtgcaatggctcaatatgggctcactgcaacctccacctcctggtttgagccattctcctgcctcagcctcccgagtagctgggattacatgcacacgccaccaccattggctaattttttatttttagtagagactgggtttcaccatgttggtcaggctgctctcgaactctggacctggtgatctgcccacctcggcctcccaaagtgctgagattacaggcatgagccaccatgcctggcttctttctctttttcaaaacagtaataagactagtacttctcaaaatatatcccggcaaactcttaatatacactctgtaaataaaagagatccaaggtcaaccaagtctggcagataccagacttctctgaggtttgaaaatgctcctgagcttggtggccacccaaagagctctagtatgtagcacctgtttatgatatgtcagtcccagtgctagaatgatttgttgcttctaagtgatataaactgatatatttttaaaaaatcgtacttgaactctccacaatatatttatcatcactgtatgaaaatatactagagaagtactgacctctctctctcttgccttttctttgttaaatgatgaaatctccttctcttctggggcggaagtaaagaggatgggctgagactgtatcagaactagtgtaagtggaagagactgggtgaagttgatgtgaaggccctggttctgcctgattgaatctttgtgggttggaatggcttgagactatgattgtgacttttaggggtacaaggtcaaattgtgaccaattctagaatttaatgtccaagtaggccagcctaggaaaaacaataatgaagcctacatttgtagcttcttggtgaatacactaagggctggttccaggggttatagagcctttattgctcagtggttgaagcaacaatctttggaatcagttggatttgagtttgaaactttctttgccctgtgagaaggctacgtgactttaagtgttaatataataattgtacctatctcataatgcgtttgtgaggattaaataaggcaactgtatgaaacacacttagaccactgtctagcatatggaaaatgttcaataaacagcaaagtttttcttttttttttttcttattttggtggtgattgttatttcagtatcagttatgagtttgaatgttctcttacagaggtctatcaaagaatatgcaaggaagccaggaatgaaagagatagctctagaagaggccaagctttctcaatcttgccagcattggtattttgggtaaaataattctttgttgtattgtttgttctgtgccttgtaggatgtttagcagcatccatagcctctaccaactggatgccagtagtaccctcccaggcaaggcaaccaacattgtttccagacattgctaaatgtcccttggggtggaggtgggaaaaattgttccaggttaagaaccattgtgataaaggaagtaattttccagtgagctgagaagtgggtagaaaatgaaggaacagaaatgacaaaaagaaagtagtcagttaataaatttgctgctgagggagggagggagagagagatatatattaatggataactagaggagaagattaagaggattattgttattgcaaattattattcatttttaataaaagatatggttggatatgtttaaatactgaaagaacatagcaaatactgaaggagaagttaaagtttgtcacgggaagttacagtttgtcatgggaagttacagttttcctttggcaagcttcccttccaccttattctggtaggaacaggaaacaccctccagccccccttctcttttcctttcatgtctagaattacctctttctcactccataaggctatagggaaaattaggttactaatatgtaagtaccctccctcctggccatagtacatgccagatctggccagtcatagcacctgattcccctttgcagtaagtgtccttggctgggacaaaacaaatccttccttggaattttatacaacatatggaggaagatagattctttctgtttcctttatgttaaagatgtaagaatgtgtctctacagctcctggtgcccatgccccatacctatggaagacacagaaacaatgtggtcaagacagagatgggaactgagataagacagaaagagatagagagaactaggccatatgtgatggctcacgcctgtagccccagcactttgggaggctgaggtgggtggatcacctgaggtctggagtttgagaccaccctgaccaacatggagaaaccctgtctctactaaaaatacaaaattagcttggcatggtggcgcacgcctgtaatcccagctacttgggaggctgaggcaggagaacagcttgaacctgggaggcagaggttgcagtgagccaagatcacgccactgcactccagcctgggcaacaagagtgaaactctgtctcaaaaaaaaaaaaaaaaaaaaaaaaaaaaaagatctgtggttgtagatactgccatgtatgagcccatctctcacacagcatcatcaccaatcatgtggaacagttggttcccatttatagttaagtcagttaggtttggttttggcatagactgtgaatagagtctacaaagataaaggagagggaaggtatgatcagtagaacaaggtccttcaataaactgaagtgcatgagatcagggtcaggcagagagatttcccttagataggaagcaagccacactctagagatgagtaggagagggtggtattggtatttggtggcagaagctatgggaggcaccatggttaagatcagtaggggatctgtaagcatgcaatcaccagcaagttatctatgatctcacttttctctcttccactcaaggtaacattccccaaacacaagtgggagatgttattttacttctaaggtcatatccattgcattttaaaaaatccctccaaaagacaaaatattttgaaacttgagtaattagactattattagcactacatttctgacaacttacctaaccccatagtttcaaatactaaaaatcagagtaacttgagtaatgtgactatttttgttgttacatttcttgggacttacccaataactcatgtggtcaaagcctgtgggttgtgccactatagctgagagcaactgtattgactaaaatcacaataatatgtaagcttttccattacttgattataactgcattactgtatttgtaactgccttttagtttattcttaatgctagtgagcacttgacatgatttgagagttgcagaaaatagcccaaccaccaccacgactttatgaatagtaatgcatggggtatgtctgactacttactctagacctaccatagacatgactaatcaattctggcattcattcctattgggctcgcatgcagccacagaatccttctcggccttatgctccagagagtataaggctggcctcaaagatgcaatgcatttgctattgttgattggcttagaagctcttggggttcattcctgttcatttcctggtgaagaagaaatggcctccaggatctggcaagaataagggccctggagcagccttgagcatctggctctcaatttccgcattctttctctccctttaagaagaggtgagatgtgatgagaggcacaggctgtgaggcctcaggcttttatctctggcaatgacatgggcagcgtgacatgcagggtaatgaattgccgtctttgcagaaatgaataagttgtggtcagtgatgaaatgatcaatttgctccatcatgttaagctgcccattcatcatccacacctgctgtcaggagcccagggccgctgatattggcctcaagcctcttcctcagctagccgagcaatcgccgttggagctgcctccaagctcaaggctgcctttgattacagcctttgaggaggggcccaattacttactgctcagccaccggtgactctgaaaacaagggacatttgtgctgacctgggctgttgacatgtagcctaacaaaatgtgaaagaccctctgacagggatccaggtggcccgtcttattgtcccacagtgcgaccttgggccaggccatgtcatttctgttccttagcttctctattataaaaggaaggggtggaggagactcccagttctccatctccgacccaatagatctgcaaatgtctgctatggaaaggacagtttgtgattttaactcccccacccactgaggcaaataacagcatttattagctgagattgtttggcagcagtgaatcattctttggcttaactgaaaataaggtgtaattatcacattttactgataaggaaactgaggcctaacaaggttaagtggggtgcccaaagccacaaagagaggttgtgttatagttacaattgaatctgtatctgtttgacttctaaacccttgcttttcccactgcaaattgttttggctagagagcaggctattaagacattctagccaagccaatttcctgagagttctgcaggtaccaggtgttgctggagcccagcatctgctcagaggaaggcagagagacccagaggaacccagaatgagacactcatttttgcatcctcagtttccaagttaattttctagctcctggttaggacccgaattacagagaccaggcagctgtccaacaagaatgctgacaggtttcattgtcctctagggtagctgctgcctaaagaatatttgattttttgtttttttaacaacaacaaaaaagatgggttccctgtattgagcatctcctgagtgcaaagccctgcactatgtgctcaacacttgatccttgatggtttaaagcctcaacagtgtgatcaggttagttgctcacattcttggatagaaaaactgaaacttagagcagataagagacttgtccaaggtcatttagctcattagtggcagagctgtagctcaatctgtatccatcagtcatctgtccatcaagtccagtggagtagaaggggtcacacaatgggctcagagacagagaaccttgtgctagttcacacccttgacctgtccatgtatgtatggacatgtaagcttgggcgggttacacagggcttggttttcttatctttttttaagggcttggtgttatttttaaaatagcagagattctaataacagcagctacctgttattcaactcttattatgagctggcattcaggtgtttcattttatttcatttctgaaaacaatcccatgatatagcatcattatccctattatatatatccaacaactgagactagaaagggaatataacttactccaggccacaatgttagtgaatggcagagctaggattctctgacctcgaagtcaaagttctcagctacttagttatacaggagaaatgtttcttaatattgaatgtgcaactaaatcacctggggatcctgttaaaatgcagattctaatttagtttgtctagattggggcctgataatctacatttcaaataagcaagggatgccaatgctgctggtccaaggaccacactttgagcagcaatgccctggaatctagttaaagcttgacaaactttttctgcaaagagccagatggtaaatatttcaggcttactgggccataagtaactactattactttgttgcaactacttagctttgccattactgcaaggtatcagtcattgataatacgtaaacaaatggatgtaactatgttccaataaaactttatttattaaaaaaaaacaggtgatgggccaaattggctcatgggatatagttggcaaacatctgagagagtttccagatcatttagcttccatcagcctcattgtcttttcacacccaccactctgaatagtctaatgcaatggctctcaaagtatggtccattgatcagtagcatgagcatcccttaggaacttgttagacattcaaatctgtaggccccaacccagacctactgaaccagaaaacctggaggtgagcccagcaatctgtagtttaaaaagccctccaagtaatggttatatgtgccaaagtataagaactgagaaagaattgacatctctgaaatgtaggcaagacctcgtgccttccacttttggcagaatgagaaggcacaagatgacagggatgaggactcgaagtctggtgtcagatagagctctattgaaatattggctttttctctgattagctttgtgaccttggccaggtggctgaggatctgggaacaaaccacagcttcttcctttgcaacaacataagaatataaagtgtttatgaaggctgaggagtcaatgaaatgagttgatgcccacaaaggatttggctcagtccttggttcataaaaagtcctcatgaaatggaaaccattgtcctcattatgatgaagagaagtcctctaaatagtcccagatggactggtatgaactgtcaaatggaggcaactgggggcttttgaatttgagagcagaaatagtaaatgagaccaaatatgttgtgactaaaaatattgcatagctattggcttagctgtttaaagggactaagttaagagctagccgatcctgttcacccttctgggcactctgtagtgaatgcttgtcagttattatagtaaaccttgatttgtatcttctgagcagggctctggcccagaagatgcactgtgtgcttgaggccctgctagaagtggaaaaattaccagctttggatccatgtaggcaaagatttgaacctcctgctgctctagcatctgactgtgtggtcgtagcaagttgtttcacctttctgggctttattttctcttctataaaatggggccagtgttaaaaacctcattgggttgttgtgagaattacaaatgttgtcatttattttttttcagtgtactgtgtaccatgcactttctgtggatataatgagcaagagaaataagccatctctgcatgcaggagtttcagcttaactggaaaactaaacaagaaactacagtcaacatgctatcatggggaaggacaggagtctctttccggagaggtttgtccagaatttcccaacattggctgtacagcagaacgaactgagagctttaaaaaatgccactgcctttagtaccactgcagaccaactaatcagaactcttttttctttttcttttcttttttttttttttttttgagatggagtttcactcttgttgcccaggctggagtgcaatggcgcgatgttggctcaccgcaacctctgcctcctgggttcaagtgattctcctccctcagcctcccaagtagctgggattacaggcatgtgccaccacgtctggctaattttgtatttttttttagtagagatggggtttctccattttagtcatgctggtctctaactcccgacctcaggtgatccacctgcctcggcctcccaaagggctgggattacaggcatgagacactgcgcccagccaactattcagaactcttggggcaggccttttttcatatatattatatataatatatatgaaatatgtatattaactttttatttaacataatatcaaacttacagaacagttgtaaaattaaatataaaatattgccacttctttcagcattgtactggaggttttagtcatggaaattaggcaagaaaaataaacaaaagacattccgattgaaaaagcaataaaatgatctccattcattcatgacataatttggcatctacaaaaccccaaggaacatacatacatacatacacacacaattagaattaataaataacttcggcaaggttgcacagtatggggtcaacgtataaaagtcgattgtatttctctacactagcaatgagcaaacaaaaaataaaattggaaaaccaatttcatttactgtagcaccaaaaagaatgaaatacttagatttagaaatacacttaacaaaataagtgtaagacttctacattaagaactacaaaacaatgttgaaagaaattaagatctaaatagaaagacatcctatgttcttgggttgaaagatttaatattgttaacatggtaacaatccccacaaggatgtactgattcaatgcagtccctatcagattcccagttaattttttttttttttttgcagaaattgagaagctcattccaaaattcatatgaaaatacaaggaacccagatagtcaaataatcttgaaagttgcagtactcgcatgtcccaatttttcttctattttttccctgctactttttctcagtctctctttctctctacgaatacatgtacatatgcgtgtgtatgtttttatatacacatgcatacatacacatacatacacacacttttttctttttttgaactgggaataaggtaaagaaagacaatgctttttgttttcttaaatactttgggtcacattgcttcaaaactaagatattttatttataactctaatataattactgacatcaggaggttgctattaagatagtactattacctaatctatacatttcttcaagtgttccactaatgtttttacagcaagagaaagtcccagcccatgtgttgcactcagttgtcatggtctcttgggatctttgaatttggacagctttcagcctgctttgcttttataagcttgatgttcccaaggatataggtcagttattttgtacggtgcctctcaatctgggtctgtttcatgtttcctcatgattagattcagattatgtttttgtttttgtttttgagacggagtctcgctctgttgctctgtcaccaggctagagtgcagtggtgtgatttcggctcactgcaacctccgcctcccaggttgaagcgattctcctgtctcagcctcctgagtagctaggactacaggcacatgccaccacatccagctcatttttgtatttttcactgagacggggtttcaccatgttggccaggatggtctcgatctcctgacctcgtgatccacctgccttggcctcccaaaatactgggattgcaggtgtgagccaccccgcctggcctagattcagattatgtatttttgacaagaacaccacagacatgatgttgtggctttctcagtgcatatcaggaagcatgtgatgttgatttgtgatgttaactttggttaaggtggcattggcgaggtttctccactgtaaggttattatttttactttgtaattagtaggctacttctagggagatactttgaggctatgtgaatactctgctactcttcaaattttctactagaattgagcatgcctctgtaatttttaagagctcattgggttgtacgaatgtcaccatgtttgagagccactcacttaaactaaagagccaacactggccgggcgtggtggctcacgcctgtaatctcagcactttgagaggccgaggtgggcagatcacaaggtcaggagattgagaccatcctggctaacaaggtgaaaccccgtctctactaaaaatagaaaaattagccgggcgtggcggcgggtgcctgtagtcccagctactcaggaagctgaggcagaagaatggcatgaacccgggaggtggagcttgcagtgagccgagaccgcaccactgcactccagcctgggcgacaaagctggactccgtctcaaaaacaaacaaacaaaaaaaagagccgacatctggcctcctggaagaagagatgtttaaactgaggccaaaaggatgagtaggaatagccctagtcactggaaattggtgggtatggcactgggagtagatgttctaggatcataatagtcccagagacatgcaaacatacaagatacctagaaataagccgggtctagctggccagcagagagtacgatataggatgcagacagcaggtgcaagcagggggcattcagtgagtttggacttattacaaaggcaaggaaacactatgaaatgggttcaaccaaggaaatgatataacaatttttgtgctgaaaaaactattccctgactgccatgtggggcctcaatttgagggtggcaagagtgaaggcaggaagtgcagtgaggaggtgagaaggtgataagtgcctggagagaggaaatgacaaccgactacggcagtgaagatggggatcggcagatatacagcagcactgagacacagaagcactgtgtggagagggtgagtgtgaccactgggagatggcagaacatgacgacaaaggagaaagggcttctacaatggatgtgtgagatcagataaggcttcctggaggaggtggtgtgtgccaagccctaatggatgagtaaaacgtagccagataaagtggcaggtgttgcctgtgttctaggcagaaggacaagaggtatgaggacctaaaagcactcaagaaggctgaaacctccagaatggagcacgtggatgtgactggagagagaagcagggctgagtcctcaagggctatgagtgtcacactgagaagtgtgggctttatcctcatagcaacagcaagcggagcaatggaagggtctaaagcaagtttgcggtttagatgaatccactccagtggctcgtggaggatgacctgaaaggcaggggttagggaggcaggaagaacatctaaggagcctgtttgctaaaggtatagaagaaatagctgccgggggtccacacatgcagacgctcaacactggaagttgtcaccataactcccagctcagaaaggacagccaggcagatccattgcaagctttaattggggtcttttctgtaaaccttcggagagcaggtcaaaagatgaagaaaacaccttcccatgcagaagacagaaaggaaaacaacctgttggctggggatggggagaagagagaaaaagcaagggtctcgctccagtgcagaatgaagacaaatgggcagcgagttccggagaatacatcctttctccagaacacttgcctctccatcagggccacgcaaagccctgtcagtcgcgagcagagcttttgtgtgcgtgccggctgcgctcccgttgccatggcgatggggccataagtcatgtctgctggtgctgcacagagccgctgtgatttatgcctgtctcgctgggattgtaaacttttttttaatgttcaaaatccgtcacagccagggagggcagggtgtctctggctcactttggaggagaggaggtgttgtcagaccttgcctgactctctgccagtgatgctcctccgagccctgcagctggggtcgctggaccatctaagccaggctctgcagaactcccttctgactccagccaaagggtttcaaaaacctgaggttgatgctcattcctgaggccaggctactacctcaggagtatcctgtattcaattctttgttttgcctccccaggcttagactatgcatgccagctttttatgctttaatttggcttaataacctgcactatatcccagcctctttacaactggatttctagaaggtgcaatggaaagaatgtgggtttgaaatcataccttctaggcctgatttttttttttttcatccattcaataggactaatataccttcatctaaggcatgtcttctcaactttagccttttgctattgggggttggatagttctttattttagccctgggcattgtagggtgtttagcaatatccctgacttctatctactagataccaatagcaccctcccagttgtaaccccccagaaatgtttccagcgattgccaaatgtcttctgggggacaaaatccccctctttaaaatccagtttagagatgaaggaagtgaagattttcctcctgacctatactattctcagcttacacaggaaaccaaaatttcctcccaaagaccaggctgatcattccttctagatgccatgtttacctgactggaccagacacctgcacagctgactcagcccccagaacctgtgaagtccagtgtgtgaatccagccagatccatgtcatgaatctccccaggctgccccatttcaatacagttaactcagtccggtcacacctaggaggagactgcagggctgaaagatgctgtaagaggaggagagaagaggtgtattgtggagccatactgtctgttccagggactctgcaactagagtgcctttaaggtgtgtggcataatttgctagaactggcagggatggccatgcacccttcccccaaaaccattcttttttctcttatttcttccccccacccagccccccaccattttttattttggtaaaatacacacaacataaaatttactatcttaatcacttttaagagtataatttagtggtattagtgtattcatattggtgtgccatcatcaccaccatctatctccagaagtcttctcatcttgcaaaatgaaattctatacccatcaaacaataactctccattctcccctcccccaactctccgcaaccactattctactttctgtttctatgattttggctactctaagtacctcatataagtggaatcatacagtgtttgtccttttgtgcctggcttatttcccttagcatagtgtcctcaagattcatctatgttgtagcatatgtcagaatgtccttcctttttagggctgaataatattccattagataaactgttgacagatagttgagttgcttccatgtttagctattgtgaaaaacactgctatcagtctcatattctttttggaagcatctttgagtctcactccaatgactcaatcatcatgtacttaatgaacacttattggaggcaaaaccttaggaagggcaagtagagtatgcagaaaacaagagtcacaataatttctgaaaaggcatgagtttaaaaatatcctaatgaaggattcctacaccagatcaaaatctgggctaaataattgtaatataatgacaacaacggtagccaatctatttacgctaaatgcatcatgcatcaattcacttgattctcaacagcatttgcacaaggtagctacagttatttctacattgcaaatatggagaatgaggcagtgggatatgttaacttgtccactgttacccgcatagtgaatggcagagctaggatttgaggcagagcatttagcaccatagcctgtaccactgatgggatgcattaggctaaagggtttcaactggcagggttgcttcttcttcactactctgtctcacttacttttcttcctctgttgattctaggaaatgttatagttctactcacctgggacttgttctctttctggaatatcccagcatgggcatcctatccacacactgcctccccagtgaggaccctatgtcttctgcagagtcagggaaattaaacagggagctcagaggttggccagcttgactaagccaacaggagagagaccagttccctctgcccactcccaaaatatgtgtgtgtgcttcaaaagatgccccataggaaccaaatccctcattttctgatgtttggtttaacttgtgtagcctctaagccatgatggactcatctggtattacttgatgtcttcaggaatgctggtcttgaacttgctcctacttgagtagtgttggagagattgtagtatatagacttcatttcttaaagatttatgacatttgttcacatattaacatccctgggaaaactgccagcaaggaaatcaatgtagcaacttcatttataatagggtttctcaaaccttttaaattatggaatcctcctttttaatttcgttgcatctactaaccccaaagtactagtgttatttggaaccgcgagataatgtgtgttgtcataatataatacaataggcactgggatgcaagaaattttgataggactgttttgatggtagagtgtttataggtaaggggattgaatgatactttgagatagcgtaaaggtgtttgttaagcaatttagtagtaatatcaaaacatcttcgtgaacatacaagcagagccacataaaattaatgtcattgcaattttctatatcctctctctgagctatttactgtgcttagaactgggaatacaatgatgttaagattcgatccatgaactccaggaacacatagactaccaggtgagggcagaaagggatactaaactacaattgactccaatgcaatataaggcaatgccctgacccttacatctggaaaaaatatttttgcagcatgaacatagcaatgaggtgcctatgattctggagggcacattctcaaaaggatgctcagaggaagtgatgcttctgtaaggctgggatggataaggagtagtgtgctaggtacactggggactgtgagttttgggctattttaggcagagggagagcactggcaaaggcaaggaaaatggaaagtgtacagcattttgaggaaatagcaattgaggacatggtgggagatgagatcagagggtattatggccagattgtgaagtgctactgaatgctggctgaaacagtatgaatttttattttgaggcagttgaaggatggggagggctctaaatggttttaagcaggaaacagccatggcccaattggtacagcggttggattggggatgtgcacagagtgtggtggggactgaaagcagtgagactacgtatgagggcctgagccagaaagtgtccacgacgatagagaggcatgaccatttttgaggatattttgaaggtaggatgaaagaacttggggctttcctccatttgctcctccaagctcactctcagcttattcttctcttcccttgtgctcaggaggctgactttgatggatggactcgatgggcttttgtagttggcttctcactgggttcagccaatggcagcaccagcaggaggtttggtgagaagtggttgggtgcagttgggacatttattttcctggctcttttgcggcagagtcaccatgaactgtgtgtatcccttgactaaaggcctcagctccatggaattccctctccatgtttttgtaacttcaccctcaccttgacccagacactagccacagggcactgcagatctcttgttgcttttctggaactttccctcaattttgtgcatagtccccttttaaatctccccaagcttgagcatgccacctgtttcttgctgggatcctctttgatattagtcttcttgtttggtgagaggcaaaggagttgaacctaaggtacagatcaattaattattcattgacatatccaactcatctttctgactagactgccctggggtgtgtgtgtgtgtgtgtgtgtgtgtgtgtgtgtgtgtgtgcgcgcgcgcgcgtgtgtgttgactactgggtggttgatgcctattgggcagagtaagatacgctaagggaaacatggttctactcagctgcaacgagtgggccttaaaaggcagaatgatttctcatcttagcttatcttggtgatcactgtccctgagctgctgtctgcataattgaaagtatggcctgtttaggtgagacagagtgaggctttccaggaaacaacactgtgagaccgtggcaggcaacggagcaggaggcaatgagatgtctatcagcagaaggtagattccatcactcaggactgtccatgcaatggcagaggataaaaaatatgcgtcagaagatcccttctagtctgtgagtttataattgtttaaacaagcctttgaaactataggacacaattcaagggccctatgatgtgggtagtttgttcatagcttttaaatataagtgacaatgatagtgccagaccagagagtatctaggaagtacctacatggaggcctttactctgctacaagccagaaatttatttcaggaaatgtattggtaacaagataagattatccaaatatatcctctgagataacatagatggatggaaacttgtggataagacagttccatttcaaattcatcctcagtatctccattcacatgactgtcctttctctcatgtctcagcaaccaaagttatcgcttcattttgtaggggaacacaatgaggtcatgacataggaaatagggaggacttctaaataccatcaggttcagagatggcaaacacatgacccttctgttacaactcctcctccaacactgaaggtgggcaaatgagttcatcatgatgctttccccagcttagtctgtttgtagtctcagaaaccttcccagcataatatcttaggcagcccctaaccatgtatctgagttggcatgtaggctcggttaatggctgccgtctttgatttagtccaacctgttagatgaataaacttaaacattcagggagaattttgaagacatgggttggaatagatttgcagttcatggtcctctcaattatttccatggctgtatctgtacatggtgaccctgtcccctaatgataagccagggttggactcctaacatgtgacagacttctctaggatttttcgaaaggagactcagggaagagaactatttctccctggtggtaagagtcacaaagagcttggggagtcatgattatcacaacccctatcatgacaagatggggagtacagaaagaaagtggttgtacaatagaagagaatgaagccatcatggaatgatacagagaggaaaaacagaatcctaatattatctaactccctcaactttcctcattcctgtggctgagctgatctctttccctttccatgatgtcattccaatagagttgccattaagctaacttgaattgggcctctgtcccctgaatcccaaaccatcctgattcatacagagcagaaagggcttccatgcaggaagtgagggagaagccatggaatgatgaatgggtagatggatggggtcttgaggtcagaagtctatgttcaaattctaattcatccctttaccatctgtgcttcctaaggccttagaatgtcagcttcctcatctgtgaaatgggagataaaaatagcttcaacttcagaagatggctgtaaagatcacttacaggaagctgagcgggaggcctctgcccaaaatgctgcttatcactatctccagtttggggtcaggcttcaaacccaggtatactaacccccagcccagtatacatgcccaaaatcatactttcatgtgtctctctctttcatctaaagatctgtagacgtgtctcaacatcagaagtccccttttaaaagtgtttaacttctaatgcagatataacaactcatttctcagtttcactgtatctgcaaagctttctataattcaacatcaaatatttattattacatttattaaagttttaataatttagcatttcctgcatgtaagatagaagcttagctaactggttcccctttatccagcctgggtcacttcaatatttatattccaaagtctccatttcagtttcatttagcagaggctgtgtcttgagccctctatctgagctgacagttggtgcatgctacagtctccccagtggcaaagacttacagaaatttggtgctgaacaatgtttgaagagatttactgagcctgggcagaaactcatcctaatagacttcacttttattatgattgctaaggtaaaatggggaaaaatatatatgtctccaggctcactggctgaatgacaggtagtggggctggaaagagtggagggcatagagtacgtccacctgggaggaagtgtggtggccttttatagtaatgtttctcagacgggcctcattttctttaaaaaaaaaaaaaaggagggatgtggaggtaccacgaaaatgctaatgcccatattccatgaacctagctgtgagttacccacactctttccccttccccatttgatatttcaccttccacttgcataaagaacacacacacttaatagaccaaatgctcaacaaagaccaagatataaagtccaatgaacctattcctccatcttacagagaatgccccttcttcaacaacagccaacatttactgagcactcacaaaacatcctgagttgaaatcctgattcggccacatactacccatgtgacattgcatgaatgacttaacatctttgtgcctcagtttcctcatctgtaaataacaataactacatcactgagttgttgtgaggagtcaaaatgaaaacatgtagagcacttaagacattgacaccaagcaagtgtgatcaataaatgttagtcattagtattgatgactatggggctaaaagtttaagtgttatctcattccattctcaaaaaaacattcaaagatagagtgttagttatcattcagataggaaactgaggctcacaaagtttaccttacccaaggtcagctagtcagtggtggagctgggatttgagactaagcagtttggctccagtatccatgctattcacttcgcccaatacctcttctgtgtttcaagcaggtaagtgggttccctattgaagttctgtcaccctttgggaaaggaacatttgtgtgagtaataggtgagaaaaggaaaagtttagaggaagcatgatggacttgagagtctacctgaagaagccacccttctatcaacatccctactgaaaaggaaagcacacttctaggttgcctacaatgtgtgcacacatatgcacacataacacgcatgcactcattaatgaaagcttgtaagagagctgcaagggcaagaagtcagttttgctcacctccaacaggacagagatatcttgaatattaaatgatgtaagaccggtatcaagggccttccccccatactctgctgccgggatccttctcaagccaagtgcccccatgcaattcatcgagtgactggccccgactccagcctactccacgtgtcctgctgccccaaccctcccttctgccatcaatgctcctgccatcaatgcacaatgtgatccagagaaaggaggcacacatcccttctttataccgctctgaaccatgaactacatcttttaatcacggacacactgcatcacatggttgcttccttaactgtactacaattctacaattcctactgcttctaaaacttctcattcattgaatatcagttacatgtaatatgctgtactagtaaccctatacacattatgttatcctaataaccaccgtatgagaaaaacacacaaatctccaacttcctggttctgacattgaggctcgaagaggtgaacaaactttgctcaagttaattctacactctttcctactccttcttctctttctggtttttctacttctagagcctagcacaatgttcattacacagtgaagtacctggtgtgcatttgttgaggattgcacctgaagatgtatggcccatgtttccagaatgcactgtatctgactaggggtactgcctagtcccaagccagattccagtatctggagcagtcacacaggaacatctgttggggaccctggagcagtgaatgaatacactaccctaaagtgctccaagagtcattgctgactctgctagcccaggtggttaacagctgaaaaaagagagaaaagaggagagaaaagagcatgcatgttctctctgctgtccttctctcccttcatcaactgccatgcatcccttggcactacactgcagccaaactgacatggaagttcctcctggctgggtgtggtggctcacaactggaatcccaacactttggaaggccgaggtgggcagatcacttgaggtcaggagttcgaaaccagcctggccaagatggtgaaaccccgtctctactaaaattacaacaattagccaggtgtggtgttgtgtgcctgtaatctcagctactgtggagggtgaggcaggagaatagctcgagcttgggaggtggaggttgcagtgagctgagatggcaccactgcactccagcctggatgacagagtgagactctgtctcaaaaaaaaaaaaaaaaaagttcctccttaggcatgccacactttgccagttcaaggtcctgtgccttgcccatgaataaaacatctctgggtttttcttatccaacatctatttgctacctgtcctgctttttcactggggaactatcctacctgtgatctcaatccaggggttaaggtgctcctcattcaaccctggtttcaagggtaagttggtgacccaggtctgcctacttagaacactttgtctcttgagagattgatgtgggatattggcaaagatcccaaaataggccaaagagaggcaccatagcttagagatgaggaacatgaactcaagagtcagactctcagattccaaacctggttctattacttactggctgtgtgatcttgggcaaggtacataatcctctttgtgcctcagtttcctcatgcattaaatggagctaataatgagtaaagactaaatgaacttatttcagtaaagcacttggaacagtgccacctaaggatgtgtgattattgctgttcctcagtgacaggacttctgcataaaccattgggaaagggggcatctcattactctggcaacacttaattgtggttgtaagcctggagaggtcagtgagagtgtgcctgaaaaagaaaaacagaaaaacagagtgcaccagagaaacacagagatgagggacgaaaagaaacaggaatagtgagtcccaacatttgggagcatataaaccttactatgccaaaagccattggcactctggagttttcaagccctgatatcttttgttttctacttaagactaagtaggtgatccattccttgttttgctacctagtgcatttgtactcaaactttagtgagcattagaatcacctgaggacttcttaaaccagaattctgggcccacctccaaaatacctaatttagtaggtatattattacatagtttctgtggctgctgcaacaaatcaccacaaactggggcagcttcaaacaaccagaaatctgaaatcggtatccctgggccaaaatcaaggtgtcagcaaggtggtcctccctctggagcctctggggaacaatcttttctttgcctctttcagcttctggcggcagctggcattctgtggcttgtgattgcctcactccagtctctaattccatcttcaaattatgtctccactgtgcatgtcaaatctcactgtgcttctttcttataagggtactcattatggtgtttcagacctgtccagataattcagaataatcaacctatgacaagatgcggcataacatctgcaaagaccccttttccaaataacataatatttataggttctaggagttaagatctgatgatacctttggggatcattatcagtctacactagatatgagaatttacatttctaataagtttctaggtcatgcgaatgctactggtccagggaatacactttgaaaaccagtgagctagtgacttcctgctaacacttcaaaatttggcatagaagttttgagtcctttcttttaacctccaggtgggtttgaccacctctgactttgtgtcttttttctgccttgaactttccctctattcttcttcaactgtcaaaaagtatgacattttttgtttgcaattttgactcatttaaagcactgaaatctttgtcttatttttatatctctattacttagtttaaaatatggtaggtgttcagtaaattctcagtacttggaattgaaaggccaaaagaacaaggagacattcctaattctattcagaactaactcaatgtgaaaactatcaccaagtgagccatgccagcttgcactctgatatcccattattctttcagcgttgttcaggaattaacagtatttcaccatttcattttcgttgatttgagatcacagaaaaatgactgaggcgctccaaaagctgagctttgtgggtgattattattccaactataatagctattctcacatttatcttataagaacctgctccaggtgaaattgtgaagaaggcccagtatgcagtaataagtgttgtttgccatgcttctccctccacaagcatcttttattccatctctcaagttggtctcttgtttcatgctccttgctataccatgaaactcctgaaagcagaggtgggctgtatttatctctgtattcctgtggtatatggcatagtatctggtacacaggagggatccagctaagatttttcagaattaaaatatatctgtatgcaattcagctagagatttgctcttccacctttgtagctggcatcgttagtgtctcaaatgctaaaatctcattcccagcagcttcctgctaggataggctggagaatgggagctgtccaggggagagttttattttgcccttcaacccctcacacttgaaagccttacccctcaccttagattgcacaaagtcaaagcttagctacagtttttgaaaaattggcaatgttctctctcttgaaaatatttgcttaattccctcagtcggatacatcttctttcttttccaatcctttccagtcccctagggcactctatgtttaccacacatgtgactcttcattcattctgtaaccatgtccatgtacataaagccacagacctagcatactgaactagaatttatagactcatttaagtcttcctcaaagcccatgacaaagtggttaatatgaatcctcaacactgagcaactatcgattttcagttgcaccataggtcgtctttagcctttcagcgaaaacatgagaaaataatgaaaagataaagagaacaaaagccactatgttacaataatgagcatgataactaatgcttctaaagagttcaccaggtagcaaactcactgctttacatgtaatatgtcacttaatcttcatcactccatatatgatatgagatttttatttccattattctgaaggggaaaccacaactccagaaaaactcctgcagcaagcaagtgatggagttaagatttgcactcagccaatttgcttgaggtccatagcctatgccctcagacaataaactttatgtttaatcaaaatatagaatacatagagaaaagtgtgaagctcagtgaattttcacagagttaaaacactcatgtaaccaccacccataacaataaatcaaacattatcagcatcacataagcccacttgtagttccccatgtcaccaccctttccatcacccagaagtaatctctatcctttcttctaacatcataaattagtttactcattaatgaaactagttttttttgtttttatataaacatatgatattattttgtgtctggtttccaaaattctatatcatatttgttagattcatccaaggtgctatgtatggttactgtgttctttcatattcattattaatggcattccattgtgttattattccataatttatttatctactttttcgctgatgggtatttgtatttttttttctagctttctagcagtacaaatgagtgcttctattcgtatttttgtaagtcctacttgtggcacacatttacatatttctgttatacatatccttatgggtgaaactgatgagctatagaagatatatacctccaactttagtacataacactccacaggtttacatagtggtcatacttatttatattctcactataaaaatatgaaagccacagttgttccatatccttcctaacatttgttatcattagttgttttaaatttagctgccttggtaagtcacagcctgtacatttaactactaagttgttctgcctactgtagtgtgagttctcatacttgtccaagaatttatcacagattagaaatcaaagaatcaacttgcagtgcacgttcaagttttcctttccaatcctactgtaatgcttaccttccgtttccctttgactctgcttttccacgtagtctttcctctaatctctttgttgtgattccagggcagtattattggctatctataattatgatctattatttattaaatttccaacataccatctgactggaacttattaattctctaaatgcccatgatatgcttgcctgggcaatgtcatgtcaaacaaggtttattagtgcagcttggaaaactcaatctacatagtgcagattctctcaaatggtgatgattgcaatcttttatcccctattgcagatcagggattgaaatgtggcttcatctcttactagtgaaggcattacctctatgcctcaggtttgtttatttatttttgaatctgaaaaatgagcatcacctcatggagctgatgtaagaatgtaataatattagtgaagtattcggcacttacttagaaaatgatcgatgatatgaactattattattattattattattaccctctgtgaggaaggcactgttattatccccattttgcagacaaataaatgaaaacgtagagaattaaacttggccaccatgatcacacagttcacacttggtagagatggaattctaaagcagccctatccaactccagagtatgtgttaccatcagccagtctgagagagctgcatcatctgaatcttcattgaaatcatggatgcaatgtcaacaggacagaactatgaggaaagctagtcaagactttcttttcagctgatttcaaacgaggtaactgtgtctttttgagaatagtcttttaaaccagatggtccttgctttatctttaaaatatataatgcagagagaacttagcacatgctttactaaaatctcgtatacttcaattctatcaaaaatgaaaacaatggtaaatatcgatgaatcagtatgtgaatgtgtgtgtgaagctattttagttcctagtaatcactatttcatatcctaagtgccatctctttataaatctattctttttaaaacatcctcttttgggaaatgctaatagcctagaaaagcatgataagttcatccctcccagtgaaagctgacaaggtgagagtaaaaacatcttaaagtaagagagttgggttctaggagctttctgtcaagatgccatagaaatactgatagcattgtgatttagaatgacccaaaggcaactatggagctgttgaaaaacagtcactggtagttagggggtccatgatttaattctagttcatgagccaataagctgtgtacaaatcagttttagaagtaaaactactctattcttggtaacatcagaatttctagaatgcttcccctaatcaaattgggagaaataaatcctccactggaaagctccagaacagtgctaagatcagatctaagaccacagacttaattaaatcaataaacatttaatagatgtccaatatgtactaggagctggggattaaaaagctaaataagttattttccttgaccttgagaagtgcaccataatggggcagaatgatatgtaagcatctaattagtatgaagtagagtaagtctataatgaagttagctacaagctgcaggataatgtaaagtgaaatgtagtctccgtggttttataagttaagaacaaaagatttagcctggacttttttttttttttttttttgagatggagtctcactctgttccccaggctggagtgcagtggctcgatctcagctcactgcaacttccgcctcctgggttgaagagattctccagcctcatcctcccaagtagctgggattataggcgtgcaccatcacatcaggctaatttttgtatttttagtacagaccaagtttcaccatgttggccaggctggtctcgaactcctgacctcaggtgaaccacctgccttggcctcccaaagtgctgggattacaggcgtgagccaccacgcctggtctttagcctggacatttaaaattcataaattagcccaaagcacatcccatggactacaacagaaaacatcccattttctaaatttttgcctttgtgactctccaacatactgttaagtaaagataagatcattaatgatcccatgatgagctagataatgcatcagcctcttttatatttaatataaccaaaaaggaaagcaatagtgttgaaacgtaaggcattgagacacagtgatggaggtcacatctaagagtttaggagcatggcatatttgacagtgttcttcacatcaactaaacagcaagaacactccttaggggttcctgtggttctccaacagggggacttccaaggttttaagaagtacctatgcagagtactggagatgattccctacctgacatctgcagggtcttccgtgacgagcacatcggtcttgcagctggccagggggttgatggacagctccacaggcggaaccacaaagcttttgctgacaggaagccagaggccttggcccaagctgaaagtagacctgcaatgtaagagtttccattggggaactccctgggaagcagagagcaaacagaaaaaaggggcccctgttcccatcccttctagggcaatttcctacttctccatccatatccccagcattatttaaggaacaatgttggccaactttctccagacctggatgatcatttctcaaatctgttaaacatttagctcatgaattgctttgtgttgctaagttccttttcctgatttactagtggactctgtgaggatagggaccattgccgctctgattttccagcagtcctgacatacagcaggagttccataagcgactgctatgtcagcagggacagtctggcacaaaggttaagagcacggactttgaatcagtttgaactaaaatttgattcccagttctgccacttaatttgctgtatgtctttatctacatgttcattgaagttttacacaagattttgtggaggtggtgggaagaggttctatggttacagagtatttttaaaccactggacttaataatcagtaatgtctcctccagttcaagtatctgagtctataagtctagctgccagacaaatgggaattagattcccatagcaacctgcgccatgatggtacattagtgccagggagagttcttttgtactcagtgcagctcagaagtgcacaggctcaatagtctaaggatccatgaccacatcttcctatcagtcctttctccatttcccagaattatgccccaacaagaaagccaactcacctgagaatcttttcaggggcttgctcccctgtcaccagatcatagcccctctcaagtgtcgtgtagggccaaggtctatgggaagaaggagaggggagagaagatgacattagtcagaggcaggtagaattcacatgtggacactgctctagagtagctttacaaacaaccaaactctgcagaaataattattgggcaagactacttatattataaaagaatgtctccaatttacagaaggattcagcactttcataaagtatgcatgtccattcaggagtctgtttaaaaatgttcttcttttctttggcagtccacttaagaaagtgttcattgattactttgtttggacaggtgacttaaatgtcagcctttgttctctagaatattcaccaatcatgtacctttaatactaaaatgtgattccatgggaaagtaggattcacttcccattgggttttgcaggaacactactgttgcagagaaagagtcctctttgtggagatgcttggggcctctggtaacagaacagaggaggtaaaagtgggtcctgcactgtcctggacctgatgccctttgccactcacccttcactctgtccccagtcactgcgcacacacaggtgtctgtgaacagggtcaggggcatagccttcatgacagctgcactctcctgtaagtgaaaagaaaaaagattattgttaagtagagtctccccaaataggcttttctctggtttgcttgttttcctaagacataaagtgagctgcttagttttagaaaaggcacatggaaagagggtaatcttgtccatcaaccactgtggttaacagagtttattcctttgttcattcactcatttattccttcaacaaatcctggccacactcgtacaggtgctcagctcagcactggagatacagaggtcaaagttgcaacccagccgctaaaggagctcacaacttaagacagggaaacaggaagtgatcaggtggctacaaatggaggtcttcttttcaaatattaaaattatgataaaatgcatttactctagaggtataatcagaaaattgaattatctccatctgaatgaataggtcttcaccatccataaatcccaagttaaatgccgctatctccaagaaacctttgatttcccctttcagaaaaacctgtctgtagtctcctggttttattttgtgttgcttttcatttttaaattatttttcctctcctccccttccttctactgccatctcttctcttgtcctcttttctcctctccctctctcttgccattctttttcatttctttcccttccatccattcattcatgaatcaatccatccatccaaccatccattatttttttttctggccatgccttacgcttggttgcatgaatgcttgctagcattacacactgccttaagtatattctctcattggccaagttcatttcaagtggccagcatatgtccaatttcctagcatatcttcagagtccagaatcctagaagtgatttcagaatctctctgtcctactcccagctgttgtcatatctgctctactgtatacttaaggtatagaatttctttttctttttttttttttttttgagactgagagtctcactccatcacccagactggagtgcagtgacgtgatctcggctcactgcaacctccacctcccagcttcaagtgattctcccgtctcagcctcccgagtagctgggattacaggcatgcaccaccatgcccaggtaatttttgtatttttgatagagatggggttttgttatattgaccaggctggtctcaaactcctgaacccaagtgatctgcccacctcagcctcccaaagtgccgggattacacgtgtgagccaccacgcctggcctagaaatattttttgatttaatgagttactgcttttttctccaaggtttatttgtgagatgcttaaagatgctgtaccaaaaacagattctatttaaaaatgtgtttgggtaataccaccccattcctcaaagccagtgtagtgtgattctccatgagggtgatacatacacaattttcaccaacttatttttctttgggagccttgttggtggaatgactcacaggattataattctatggaacacctctagggaaatgctagtaggaaccgccctgactttgcttactgcctagaatagggtcagtgcttaacaatgtgagttgaatgaataattaactatctgttattgctctggtaaatttccaggctaatgatgttggcttgtcttctttctcatcttcttgtaatcacattatctcattatctctctctgtatctctctctgtatgtatctctctctctctctctctctcacgcacacacacacacacacacacacacacagagagataaacctgtcacccttggatcctacagtgattctgatagacaggacccaaaagttttcaaatcatgtccatggaaatgtattacttaacagagatttagggactatgcaaattttatattttaatttttcttaaaagttttattttttaaattgttaaaaatataaaaacaagaataaacactcagatatcacatgccagaatttaggatactgaagaaagtatcagttgccagataaacttattttatgcaggcttcagggaaaaaaaaaatctcctctcatctttgtttcatctaaaaagatactgaggatgagtcaagatgccaacaacctcatgctatttgcaactacatattttgggaatcaggattttctcaactttatacaactaaaacaaaatattgtagtaaatagaatactagggtaacacgggttctacaactatcacccttaattctggattttgaaatgtatgcattcatcaagtaaacttattgttatctctgatgaactgtaagtgttatatatttgaccttatatgaagcattctgagtgtttaaaaacactgtaacttgttttatagatgacactgctgcttaatctttgtattcccagcacccattgacaaatagcctgggcttcatgaacgctgcctgaacaaaaatggtagtaagacagagtatggagtgaagaatgggtcagagatagtattcaaaatattcagaatgaggttgttgaaagatacaaggagagacagaagacatgtccttttcctctcatctgcttacctgaaaaataaggagggcttgctcacaggtaggaatgctctctgtactccttccctgcaacatcatgcctggggtcttccaccaagaggaagtgctgtaagtagtgctacctaatgaactgattgttgccagaggtaagaggaatggaaggaaaaggctaagagccttgaatgtggatgtaaataatttaccaaagcgaggaggggcaggagtcactaaagaagtgttaaaatgcaacagtcccttcatgaaatattcaccactttaaacacgtctaatattaaagattaaaagtcctgggatttgtcctccagactcccaggactgatttatgatctgctacaagccacaggcctcatgattcataatgggagaggtaaaatggttacctctggcaaaggagcaggaagtcaggctggggtggatgaggaggggccaacaaggaggatccctcttgtttatggaaagggcaaaggctgaggtccctatctctcctgcagtgactctgcaggaaataccacagttcacttctttcctctttctctcatttttggaaatattggtgacattgagaaatttattcagaaaaagggtgctgctatgtttttctctcctccttgtgcacttaccaggcaagttttccctgactcagaatggatcattaattactgatgctcattatacaacaaatatatattttgcaattaagaggcattcaccctggagacccccatgaggcttcctggagaacggaaagtaggcagagggaaaagcccccgagtgctagcagcagatggacccggtcccatcctcttgttctctccctagttgtgtggccttagggaagtcgcctttttggtttcagctttcatttacagaatagggatgatagcaatgtccatctcctagagctgatgtaagaagtaattgaaatagtgaagaatgaagctagtggttgaggtgacaattagctgatggtcatactacccagaaactatgcacactacatgggtgcaatatatccatgtaacaaacctgcaaatgtaccccctatataaataaaagttgaattaaaaaaaaaaaagaaaagtgtttccttccctttaattccaagctggccactgggttctggtatatgtttacatttagacaaaactatcacccctaactccttacatattagacatgtagagacacaaattacctccttttggggccttagtttctccttctgtaaaatggaaggttggagtagatcactcatcacttctgagcaccaagactctgctgtttgcattgcctttccaaatccctaacctctgctttctggatactgtttgttttagtttcagctgcaatcattcttagcagcagcctgggtgtctctagcaagatctccatcaatgccataggtattggctttattgactcctgtttcctattttgctggctcagctaaatctccactatttgcaaccaggcatttccttcttgacagatgaaaagcctctgacagccagagctgagggtaattaacctcttccctgggtgactcctttcttcaactctgcttctgcacacccagagcagcaaggccatcaaatgacagctctctagggatgcatgtaaccatgctgactgtgaactcctgtatagggatagggaactccctatccctataactctagtaccttccttgctcaccactgcatctcagcacctcctgcattgcctggtacagagtagggattcagtaaataaatgctaaatagatgaagggatatatttcacaatagtgatgcctatgccaatggaataggacaataattttttacttgcctgttcccccactaagctgggaatttcttgattgcaaaaacattttcttaatcatcctgtattctaataattagtataatgcctgataaagggtaggcaactcaattattgaatgaatgaatgaatgagtgaattcatacatatatcatgattaccatgaatttaggctgagttcatttagaataatgatgactctgctgaggactggaagaaactttctacatccaagataggtatttgccaaggaaacaaagagtgcaaacacaagtgctgatgaaatgtcaaaaatagaattctattttacatcagagcagaaaagacccttaaagatcagctagttcaaactttcccagtttcattattcagaagaggaaactcaagctaagagagtaaaggagtttgtccaaatcactggcctagcctctgggccagccaggatggaaacccagggctcttggccaccacttcagtgtccttttgctgcattggtggtatcaatagttcaatgcatcctgaagtcttttgcatcaatttttctgtacatttttgacattaccaagttttctaaaaatgagagcattgacaaacaggtattatttaaacagtaaaatgaatttgaaatacccttaagtacattaaaaacatacatgtatatgttgttagtaatggagacctaaaaaaaagaatttactctcttcactatattggttctcataagggaattcaattggatggttttctatctggctatttaccagaactgtgttatcagcagtagatgagttgtgttggttttaaaagatttactcttcatgtctcctggctgccatttgttgaggtctttttctatgttatatgcattctcagtccagaaactcttgggtaaaaacaacaaaacaccttgatcatgaacaatctgtgttcatctcctgtgaggctcttccaaacaggacaatgctttcttgccaaccacataaggccagtaggctggtgaaatagttcagagtgtgggtgggccttgaaatcatcatgtactgcattcaaatcctggatctgcctgccacttcaaatttgcaagaacctgataaattgattcttctctccctgagcctgtttcctttacctataatggagctgacaccatatgcctgtgggaaggatcaagtgctgtacttgaaaaatcctcagcacagtctttggcacatttcttcttgctgagaacacaaaacagctgtttgggttcatataattattgttcttgggtaggaaaggcccatccagtatgttgttttagcagaaaggaaaggtgcttagaatgaaagatggtcaaaaatccaagatgtgccctttgcaaaacccaaaagaccacagtttctttatctgtaatttgggattttttttttaaattatcattattatttttttagagacagggtgttgctctgttgcccaagctggagttcagtggtgcaatcatggctcaccgcagccttgagcttttgggctcaagagatcctcttgccccagcctcccaagtagctaggactataggcacgtgccatcattcccagctaatttttaattttttttggtgaaatgagacctaactatgttgcagaggctgagatcttgttcaaattccagcagtttgaatgagataatccccgaagctgttcctgtgtttccagagctacgaagacatgttgcctgtgtccatggcagcccctgctgaaggaggtatgggcacggacaaggcataagccagaggccgctgcctcctccaccccagcagcacagaggagctcatggcttgcccatgagagtgcaaagcctccttcataagccatcctggctgtctgactcccctccccaaaccctgtcattctatgattccattttcacttgcttctaactcagtcatcacttatcatcaccggccagggatgctgcctgctgttcactttcttatttgctcttcttgtcactgtggtttgaaaagacatctctctgggccctcagagcaataaacatggatcccttccccatgttgactccaagtgagccaccttgggactcttcacctctgtagctctgtaactcaactcagggccaggcacgtagtgggaaaagtatgggttgggcataacattatgagagcctgctttgtgctaaaagtggtatgtgacatttgacatgtgtcattgcatgtcacagccatgactagtacaaggaggaaggtactgatgccctccttgtaaaataaggaaactgaagctaacactcgactagtcagttgccctaggtcatagggccaggtctccaaagctcatgcttgcttacaccaccacaaacatcacaacaataaacataaccacaaggacaataacaaggacagctgcctttgacaatgatcatgtgtgagacactgagggtcatttctctgtagtacttaattatgcattcgcttctttgcagtggttaattgtgggaagagtaaattttctttccttccctttgtcttcaggcttggcatatgacttgctttgatcaatgggatgatgagagccaggacttaaataatcaaagttggaaatatatttatgtggataggctttccctcttgtactcctgcctcttgccattagaaaaaacatctacaggctgtggctggtccatgaaggatgagagatgtgtggaatagatctggattcatcctcagcttagagccaagggcagctgagtcctggctagatcagtccacccagatgtgtgacaaaggagaaaaagatgcttacttatagttgtggacaataaaatgtgattgatatgcagcgttattttggcaaaagtttctgatgtactttaaacctagatgtctacatctctataagtaatggtaccagtttctttcctaattggaaacttcagaaaaacttctaatggggccctattttgtactctcagcatctgagtgatatctgaatcccactgattctaccgctttggttttatccagacccatttattcccatctctcttctctgccactggcctggttcaggccctcagcattgtccatgtgctatgaacctattttctgtgtccctacatctgatctgactgttggccagttatcttttcaaagaacagctgcacccatggccctccccaaaaactctcagtggttttcagttgccttcagggtagaagtcacatatcccagtcaaagcctttcattactggcccagccaatttttccaaccttatcaataactctgcctccctgtgacttttatgctccaattttttctgagtctattggtaagagcagggtcacttgagaccaacgttcagaccctttgaagcttctttcagcaggtctgccttggttctacccaggggtcccactcagagatcccactcaagcaaagcctgagccctggagagagacaaagtcaatgaaggagagactaaagtaagagggagaggagaaaagggaaaattaagtggcaaacaattattttgtaaaagaatgagataatttgggcactgttgagtataagtaatgtcatcaggggatacattttacagccctgaatcctctgcaaatcattctacctttctggacctcagccttcccatctgtaaaatgagtgggtagtacttggatctcccacttttccaaatcttgttaaaattccagcccttgattcttcctctaatatattctggtctggtttcttgaaatcagcatctctcttgtaattcaggaagcaggataagtttgggggcttgggggaacagagggttggtaggcaaagaaacatgattcgcgtgaaataacaagaggatataattagaagctttatgaaatgaggaagattctttataagtctactcagccaaatgtattgtgtgacctgaggtagttccctccctctctggggctcagtttctctatctgtacagtgaggaggctggtcttgacatctgagcaacttcacatgggtgtctctgatatccctttcttccttatactgctggtgtgagactttccaaccttgttcttcccaaagcactgagacaaatgtggactccgcattgtagctgccggccccttattgttattcatcagcacgcctctgagagcacaaagtaaaaataatcagaggctgaaaggttctggtggcacaggctggtgatcaggtctgataagagattagattccttaatcaacgctacatgggggctaattattgttggctcagctcatgtggacagtccatacggggtggtcaggctgctgagaggctgccagccaggccccatcagggcccctgctccaggttctcagccagggtaaccctttccactggccctattccctttctttctagcctcttccacctctgagtgcaccacagacatgattatatattattagtgtctaggagaaaagcatgtggcaaagagcttcccgcaaaatcatggctgattaagtatggagtggggtgaagaaatctcactaacagcctggaatggacacagagcatgtatttccaacaatccagaaggatctggcttcagctgatgaacacaggacgcttaacatggatgcacagagctgagcctgccggtgagaggctggcttctcctcaccctcactgcacgccagagccctgcaacctctaagcttctcagatgcaccaggaaggcatggagagcagagggacacagcctggtaaggggaaaggtgtcagcctggcaaccaaggccattggaggctgaatcctctgtggcctgcatcaatcactgcacctctgggcctcatcagaaaacgggcatcttaaacccaatttttaaaattgtcacaaggattgcagacaatatattaaaaacagttactgcatcgccagacgtgtaggcagcacttggtatgttgcagtgtcgttatcgtgattgctgccagcactgctgtccttgctgtgctgttgtccaggctgcccccccccacccccctgcagtcacgtttcctccttgatttggtgtccttgcccctctgggctgcagctgcccttccaggcttcctgctgtgttagttcctccttttctcctcccgaccggattcatctctggtccagatcttactgctgcagaccagctacccttctctggataattcctctatacctggcacaggggagatggaggcagagagatgaatccatcctattttttctaccttcaagcagctggcattagcgtaggaagacttggaggaaaatacatcactgcacaaggtgtgattcaggctagaagaggagtgtgcaggaggtataggagcctgaaagaggattgctgagctctgcccaggatgggggctcaccagtgaaaagggagggtaacaataagagaaaacccagagggataactacctgccaggcagtgtgggaagttctttgtttagattaactcacatgatccttccaacaaaccaaggtgggctctattactaaccccatcttgcagacgagcagacagaggcccagaggggtagtaccctgcttgctgaaggtcacaaagtcaagtgtgccagagccagaactggaatccatccagcaactgtgctgcttcagagatggttctgctgtccccaggctgcactgactccctttccaggagaattaagtgttttacagagagaacaacagggatgaaagcaggccacagtgtgcttggaaaatggtgggcccttttgctttgctggatcagtggggaatactgcaggcacagccagaaggcttaatgtgcactgaggaatcctgccctggttctgcaggtatgaagaagcagtccctggaaactgccacaacccctctgcaaaaatacagttgtgcccccttatctacaagatgagttccaacccacccagtggatgcctgacactgtggatagtactgaaccctactgatgtggtttggctctgtgtcctcaaccaaatctcatattgagttgtaatccccagtgctgggggaaggatccagagggaggtgattggattatggagacagacttcccccttgctgttctcatgatagtgagtaagttcttatgagatctggttgtttaaaagcgtgtagccttaaacaaggataaatggggactaattggtgttggctcagctcatgtgggcaacccatgtggggtggccaggctgctgagaggctgccagccaggtcccatgagggcccctgctccagactctcagccagggcaaccctttccactggcccccttcactctctctctctcctgatctgccatgtgaagattgtgcttgttttcccttcaccttctgccataactgtaagtttcctgaggtctgccagccatgcttcctgtacagcctgtggaactgtgagtcaattaaagctcttttcttcataaattacccagtctcaggtagttctttatagcagtgtgagaacagattaatgaacccatatttactatgttttttcctatatgtacatacccatgataacatttaatttataaattaggcacagcaagagattaagaacaataaataaaaacaaaatagaacaagcataacaatacgctggtatcactactcttgcacttggggccataattaagtaaaataacgattatccaaacacaagcactgtgacaccttgacagatctgataactgagatggctactaagtgatgaccagcaattagcatatacagcgtggatactatggacaagggaatgattcatatcctggtggcatggagcaaaattgtgtgagatttcatcacactactcagaatgcagcccaatttaaaagttataaattgtttacttctggtattttccatttaatattttcagaccgcagttgactgtgggtaacggatactgtagaaaggaaactgtggatgagggggaactactatagccattctcaaatgctgaattcagttgttagggtggtgagagacaaatttaaaagtagagaagacaggcaatggagtcagaatggaattagagatatgcatttgccaatcaatagctcagtgactttgtaaaacttcctgtctccacccaagactcagcttccttatttctaagttaatcatgcccactcttctcattgagcaacatgaaaaatgggctccataagtatcacctgctattgctatgactactattagggagctggtggctttcctgaccatggctcttattccagacctcttggttatcacttagaaaaaggaaaataccaagagatgctcatgaagtttgttaatcatgaccacttttgatccacctttttgccttcaatccacttaaccaccctgtgaagcgggtgctcatgtcctgattttatacaggaggaaactgaagccgcaaagtgttaaatgacttgacctcagttcatatagcaagaaagcaacagggtcaagattggaaccctgacctgcttgactctgaagtcagagcccctcacctcaactgtaccatataaaatgaatgaactcagcacaacccggtgtctcatcaaaatgccctttgtgaccctacttggccatctaccatacttctataggagcttaaaggaatgtagatgagatcttgctatgtggttgtccacttcatgggatcctggagctctcttttcctgcaaattgctgggtggccttactcaagtcatctcatctctctgagtttcatcattttgacctgaaagatggggaacacaactctgttctcccttattcatgagaatgccatgaggataaaatatatgcttaaaccattcagaacacatgatgattaataattcaattccccacctgaacaaaacctgaaacagcaaagtgaaatacacaaaataaattaagccaagagtaattattcattttgcaaaagggttcttcactccacagaagagactcattgacatttttttttccaagcagcagctatctttgggaatttaaaattaaattccatttatacaattatagcaaaaatactaatgattttccagagtgcactttgagtgcaatgggccatacctgtgtgtcctgcccatggcatcagacaaggcagtctagagatccagaaggggtcagagaggagagggacctttgcttttctctagttaggaatttgagaaaaaagaagagaagctggattgtgtgctctttctgaggggttcctttctcagagtgacctcagcctcaattgcaggcagatggtcagggtcacagctagcttccccaggaaacaagaggattgccatttccagtcccttccatctggaatattataccattttacgtaatgtgtacattcagctgaacccagctaattttcactttgctaatctcatttctgattatatttgggttttttttttttttttgatgaagttttgcttttgtcacccagattggaatgcaattgtgcaatctcggctcactgcaacctccacctcctgggttcaagtgattctcctgtctcagcctccctagtagctgggattacaggcacccgccaccaggcccagctaatttttgtaattttagtagagacagggtttcatcatgttggccaggttagtctcaaacacctgacctcaggtgatccgcctgcctcggcctcccaaagtgctgggattacaggcttctgctttatgttttctctcttttgcttcatctctgtctctctttctgtttctcaacgttgtttttgtcacagcctcggtttctctctttggtctctgcttctgttttttctttctcactgtgtgtctatgttctttactatttgtctttctctatgtctccttttcttttagaatgctctgcagtaaaaataacttgagtttagagtcagagaggtccaagtaaaatccccaaatccactttaatttccttatccacaaatataaaaaagtatggtctgccttctttaaggttcaatatgaagatgaaataagacatggcacataaaggtgccaccaaaaaagagtacagtcatttcctgttaaatcaatttcccccttcctttcttcttaaaagttcttttgtttgtttgtttgcttttaagacaaagtctcgctctgtcacccaggctggaatgcagttgcacgatctcagctcctgcaacctctgcctcttgggttcaagcgattctcctgcctccgcctcccgagtagctgggactacaggcatgcaccaccatgctcggctagttttctattttttagtagaaatgaggtctcaccatgctggccaagctggtctctaactcctggcctcaagtgattgatctgcctcctccagcctcccaaagtgtttggataacgtgcataagccaccacacccagcctttcttagagttctttaattttccttctttctcttcccttgtcttcccttccattcactccactgcctttgcaccactctcaaacaaacaagcacactacagcccccactttctggcaatgatttaattgcagaacagtgcaggttcccattaccaaggctctcattcttttacaaaacatttttacagtacatttcctgggatataatggagaatcattgtgagtcattaaaattaagcaacgtgtgtctaagcagcctgcatcaggcttcactacagagtcaggtttcattgttaggttcacttctggccattggagagtgtgatgggctgttcacaccacactgggtaaggtcacctgaacttacctgagttgtgtgggacattttgaattctggatgccctgtccaaaggaagagtcctggtgttagcaacgtaaatccatactccaactgcccatcacatactcccattttctggtagaaactcaaaccatctagtgaaattttaattaagagaccattcaacatcgtagccaaaaggcagggacataacagaccattcatcacggtagccaaaaggtggggacacacacacacacatacacacagaaacacatactcctccttctattcagaggcctttagtcatccacactgaatcaaatgctgccttcagtctagcaaaaggagagaggatagtgtgctgcaatgggcagactccctacaggcagtatcaaataaccagaaaaggcaagtgctactgctaagtgctgcatttcaaatggtttcctagaggtcccttctgcacagaaatctgtcatcatgccttccatttcatcatgattaagtcttttgtgtgttaagtattgccagcattggggggttctttttgtccctgattcaataattcccatatgttgaacacatatcttttccatataatgtagcagatacttcgtaccgataataatcgtcacaataacttaccaaaggtgaatacttctccctcttattaaaaaaaaaaaaaaaagcagaaaattgaggcttggagaaattaagtgaattgctcaaaattataccaatagtcaggggcagagtcaggggcagagcccctgctcagcctccaccagtggttcccccttgcattcaggacaagatttcagccctggtctgtctgatttcagtcctaggctctttccatgttgccctgactgcctctctaaaaaacaaaacagagcccagcattcatgcagcttgatcatgagctcttggaaggggccagtggtgtctcttttgcttctctccctggtgactgactcaatcttcaggctcagtcaatgtctatgaaacaaagacattaatgaagcttatgaggaacacacatgccccagatcctctgcactgaaacacttatttatatgaatgagcgtacctgagcacatcccttcaagacaagcccagaaaagcaatgccagaaaccagcaccaccttcacatgtggcaagaggccatgcaaaatgtaatggctcaagtttggagctgggaggatgggggcttacatcccaaggataaaatattttgactgcttaatatgttctcaagaggaagaaaattaagcaccattatggtagtgttgcagcctcctctctgccactaagttactgaattactaaatgaaccctcccaaaacctcaagctaatcaggtgtagaaggaagccttgggccagataatctgtagggctcctcccacccctggagccttttgttatatgcctccacagtgcccaatcctacttgttatctcagcagagtctttaaaggcttctcaggagaaggggtagaggcaagggtcattaattaatatttttccctccacatttaagagggcatgtagaattgtgtaaggacagggttatcacctaaaaatgagtgcctccttgaagtttttgcctgaggtgcctcattcagttcattctggtcccagccctgcttgacaaaaggatcagcaaagctctattcaccctctcacttgtatcacatacctgcttcagtgtttctcttctcctttcaccctgagttggtgttgtcatctcctaggtcctatctttagagatggtataaaaactgggtcttgggctcaaacacatgggggacacacaacgagcaggttcctcaactctgatgtcaaagcatgaaatcagttcaccagaacctccctggggcatagacagcagcttcttttgctaactacctccaatactgagcacaatgcctggcacataagtgatgcacactaaataatagcaatgaatgaaatgcaatatctggattctgaatgcttctttctgccttggcttttcccaccctgatccaagccaccaccatctctggcatcacatcagtcttccccatcagtctcccttccaacatgtttacctctgttcctacagatgtttcctcaatagagatgccagagtgatactcttaaaatagaagttagatgacgtcacccctctgctcagacttctccagtggttccccattgcattcagggcaaatgaaaatgctaatgtttttacaatgttctgcaaggccaacccaggggttctggccctctgaacgctctgggatcccatctcctaatatccttctagtacccagttcaacccagcacattagcctctatgatcttcctcaaatatgcaaggcacaatcacccctgtgagcctttgcacagcctgttccctttacctacactatgctttccccagatatccacaaggcatgctttgctcccacaccttttcggttgtgcctgtcttgaacagtctgctcaaatttgcaaccatttctgcaacatgtacagccccctctttctacaggcttcacacacacacacacacacacccctcatcttctaacatgtgatacactttatcacgttattcactataattttattactatatatagtatatacagcaatacaatttcattactatagatactatatataggaataaagtacataagttactatatacagtatctatatatagtaataaaatatataaattactatatttcatatatagtaacgaaatatatttagtaaatagcatgataaagtgtatcatatattatatatagtacattatatatttctacatattcatatactctatatatgtatatacagtatatatatagcactttatatatgtatgtatgtactatatataacatactatatatagtatactttatatagtatgtacatgatatatatatatatatatatatattttaactatattactatatatattttagctctgtgcctgtcccctgccccgcaagaatgtaagttacatggtggcagggatttttttgttttgttttgttttctttcttctgtcagagcctcacatcctggttaaattgggtgcttgataaatatatactgaacgttcagtgaacaaatacatgaatgaatgaataaataccaaagccatttttttcaacttggacatcaaaacattaaatgaattcaatagaccaggaattggcaaaatttttctgtaaagagccaaatgacaaatatgttcaggtttacaagccatagggttgtgactgctcaattctgatgttgtagcacaaaagctgtcatgggcaatatgtaagctaatgagcatggctgtgtttaaataaaaactaatttacaaaaaaacagcagttggcctataggctatagtttgctgactcctgcactggactaaacactattaggtaaggcagtggatctgaattttcttcctgttgaatatcagtacataaacacagcacagtgtctaacacagcattgccactcaataaatattttgaatgaaatgaaatatatatgaaatatagttctgctctttactctgtcacagcactgtctaattgagcttgttgcaacaatggaaatgctctatatctctccaatatgaaagccaccagccagatgtgactgctgaatatttcaaatatggtgaatgtgactgaggagctaaatttaacattttatttcattttaattaatttacattttaatttaaatggccaataatggctaacagctactggattggacagtggagttctatcacaataattctcttgcttcatgattcagttctattatcttccacccccaccagaggaagccttccctgattgctaaggctcacaataacttttttaggatatattcatttcactcaatccatgttttagtcacagctataataataccaaatgtttgttgagctttaagtaccaagtattgtgctcagtgcataatacactttatctagctcagtcctcataattaccctccaaggattgccatgttgatattcttaccactattttacctctgagaaaaacagaagtgtaggaagggtcagcaaagtgtccaaacttgtgcaggacccaagtgggctgggatttgaatcttcatccatttgaatccagagtgcaagctcttgaccaccacaagatgcttattaagtgtaaacacttgtgttagtacaagtttcatgtgttcacatgttatctatccttcaagagatcaggaatcagtggtcttcttcattctacatatttcaaagccagaacactggctttcaataaagattttcagtatacagaacttcagagctggagagtactcagggaaaatctaatggaaatgctctttgtattataaataaagaatatgaggcccatagagaaaaggggacttgtcaaaggtcatactatgggtaaattacaaagctgggattagaggccatggagtttttctctgaattcaatatttcatctttcatgtactaattccaccattcatttttaaacatcaacagtgtgttagacaatgggttgggtatgaggaaaaagcagtggataatgcagacacaatctttgcctttataaggcacacagttttttagatagctagcaattgaacaaagaatgacacaaataaatgtatcattcaaggttgtaattatgtgctgatagcataggcttgtggtttagagggtaaattctgaggccagacttctaggtttcaaatctagacaccatcacttcctaaatgactttggaaaaaatccattaactgtgatttagtttcctcacttgtaaaatgagacgataacactatttcattacattaattctaaggcatgcaacttctgacattttatttttatttccatttttatttatttatttttagatatagagtctcactctgtaacccaggttggattgcagtggtgtgatcatagctcactgacactttgaactcctaggctcaagcactctgctcacctcagcctccaagtggctaggactacaggtgcatgccaccatgcccagctaattttctcagatttttttagagacagcgtctcactatgtttcccaagctggtcttgaactccttgtgatcctcccaccttgaactcaagttcacttgatctcaagttcacttgaactcaagtgatcctcccaccttggcctcccaaagtgctggattacaagtgtgagccaccacacccagcccccatattttaatattcctaaattgaggacttatctgataattattagtatagtatggtatagtatgattattattattggcagtattttttcttagtggtacataaactatatacatatgtgtatgtgtcttaatttatttaaaatataatcacatctacctcatataattattgagagattaaatgagataatatatgtgaaggctttgaagagtggctgacagttatcactgtataaatgtgcaccattattactatttactataaaggaaaaatagcaccaatggagcataatgcattggggaaataaactagtacagaaagtcacttccttgaggaagtgacattttaagttgaaacaagaaagataaggaggagtgaaccaactaaagaatacagtttataagaagtggggctggatgaggaacagattgtcccatgcagaagaaacagcaccatcactaactctattacattggctagaagaaatgactccccattaacaaatatggaactctttacaacatggctttatatcctaataacactctcaattccaacctaggcttcattattatctttttttccatacatttgtttattgataatatatttattgtaaggttttgcatatatatttagaaccttcctggatttattttttaaatagtaggacatatgccatttttagaagaccaatatattttttaacacattttttagataaaattaaatatagtctctaatttaaatgtcagtagattatatttatgatgttaaaatctggtcttaaaagctgagcacttcccctttttggtacctataatcatcagaaatacctgaggctaccttcttcctatatgcagctttgtggtgtgagatttcagatctctgacaaccttttttctttcaagttcagaagcaaaggttgccttggactttcaatgggactggcaagttcccaataagaaaaagttttcatagtctcttttgtagtttaccctaaccttcttgaccttctaaatttttgaacagtcaggcctggtgcttgctttgcaggctccctgaaattttatgacctcatcctagacacagattgtcctttcttaaaagaccttaaacatcttctacaacataacattttacaacacatttaaaccaaatatatcaagactaccaaacagagataaaaagtagtttccctacaacccatacatgctgtcacagttccttctacctctcagttctgtattgtttccctgccctcaattcaattcagtatttttgtttttttcaagtcaacttattcagtaaattctttgtccaaaggattcatgcctgcctctgagaattctatacaaatacctatcaaagggggaatcccagaatgcctctcttttctcaatgctaagcaaatttcctcacatgctaactccttaaaacagtagcttggccaaatcccagcagtaatacttagtaaatatatgaacttgagaatgtcaatcaactactttaagacatagctacttgtattgaagcaaaaataactacctagaagtgttattataataactgagaatagctatataaagtctttgcatggtgtttggtacacaataagtgcctaataattttagatgttgttattgtcacttcaatgttcatgtacttcttgatatctcaccaaaattccattgtacctcttttaactattggctgtatttggctgttgtctaacactccatctgctatatatagataatgaatctgcattgaatggattaatctgatgagagaaatgggatttatgagttactgacttgtttcatggaatgtaagcagaaaactttggtttcttgtcatttcaattacttttgttggaaaatattttaaaaagcttaattccattatctttcatgcctgaataacaaagtatcatgttcgttaatcgataataagttcagatgacttctgtttaattcaggttctagtaaaattcatgacaaatgagtggtgaggtggagagcaatatgggttctgaggatcagagggactcgtttcatggaggatatccccagttgaggctctctggactcatttgtatatgactaattctgaacatataaaggacagaatttaccttatttgagttcagaaaagaccagtgctgcccaagtcaggggaaaaggtgagtttcagaaaaggattaggtatctctgagcaagtctttatttagcaaacacacactttagccagagtgttgtcagcaccctgagaactctccatggtgctgacacaagaagcctacaccttactcattgaacaagccttgacactttagcagctgaaatttgattttcatccatccatccatccatccatacatccatccatacatccatgcatccatgcatccaagaaaagatgtattgatacaggaactgtttcatttccagatacagcaataaacaaggtgagcaaagaccaagacttttataatgtatatacccatatacaaatgtcccctctacagtctgccagaaagttggttctctataaacaaatatcagcatatcttactgtggattttacctacttattgccatacttcaatatatatgctctaccacatagaaagccctaaagataccacttccttcaaaacagggaatttctccatcactgtagattcttggaatttatagcttcataaaaatcctgtatccctttaaactttagtaacacagagctcagcaaatactagaaacaatctgtaaacattagaaatatttagtacaatataagattgctatatgacataaccacatacagtgtattctcatttcatatcctactacaaatgaaaagtggctgctgaagacatggaaataaactgaatgtaatggtgaacatgactgaagttcatatcaattgtggaaagaaaattcaatttgctataaatgccatttacaaattgtttcaatcatacttacatgctaagttattagtgcttaaaaggtcatagaaacatggattttgagcggagaatatcctagaaattatttagacttttaatttgtatcttgccactaatttacggtgtgacacagggcaatgtgcttagccttggtgggtcttggtctcctcatttgattacactagatgatggctaggaactcttcttgcactaaaagtatgtccccactcattgctttgttgaagagaaggaatctgaagttcacggtatgtaacatactcaaggtcgactggcaaatttgtggcaaagttgacatgagggttgaagattgaaggttagtaattattttctttctttcctctttctttctttctctctttcttttttttttttttttttttttttttttttggacagagtctcactctgtcacccaggctggagtgcactggtgaaatctcagctcactgcaaccttcgcctctcaggctcaagcaaatcttgtgcctcaacctcccaagtagctgagattatgggcatgtaccaccacgctcagctaatttttgtatttttagtagagacagagtttcacagtgtgggccaggctggtctcgaactcctggcctcaagtgatccacctgccttagcgtcccaaagttctgggattacaggaacgagccaccatgcctggccagtaatttttttcattgcaaaagttcagaagtcacacaaggactaaataaaagttcagcagatagaaatgtctagcttactctaaattcctccttcagctggttagctactagctggttagcagagatgatatcatattttcttctcacataatctaatgttatgcacattgttggattaaacgtctcatgaaatatttattgaattaataagtgaagatacacatgactgaataaatgattatagaaataagagaaaaccttgtattgggtttccaccatatattatccactgcaccagtgcattttaaattttatttttcatctcatccttatgacaactctaaaaagttgaaattattcttctcatttttagttataaaaaataaggcttgaatatgttaaatgacttaccaagctccctacaaccaggaaacagagaagagagaatttaaacctggctgtgtctgactcaggaagatatcccaattctactgtggttcactacatgcttgaatgaatgaataaacatatgaaagaatgagttagtgttccgctgtcatttgctttatgtgttgtagaccatattgtcaaaggttttatttacagaacttggtgtgatgccacagatgtgcagaactttaataaagctgtttcgcaataagacattacccacattgatattcttgagagtcaaagcctaatgatttaaactgtgtggtgttgcattttactggaccagagcaagtagtccttggatgttcactttctgtcctcagagagatgaagataatggtagtctgtcctgggaaggagcataatgtcactctggtgacatgttcaagcctccactagccacttttttgccttggtctttcattggtttgttctcatctcatccagtgttgtgctggtaaatgtttaatgattgtctttctgaaaaaaataaactctgattttgttgcatttaccaattgtgttggtgtaaacatcctcaccatagcatattttcaggctatcaacatgccatcactgaacaaagagttgggaaaagatgttaacagtcaactctcatgatgccatgtgagctggctccagcacatcacagatctaattccagagtcatccctgtgggtggcactaattgttgaaatccctggaaaaacacactggaaatgggctgtggcatgcagccaggaaaacttggccaggttcatctgtgcaccaagacaattatatatatgtttcagctgtagcatcttctccactttccttctccttccctgtcacttgggagaaaaaatttttcttatcaacacatccagaaaagctttaaggaatgataaccagtgctttgactccatgactctgtccagctctacagatttgactcacaaaggagagacttctttaaaagaagctaagccacttttgacatatcaagacctaaatatacatagggcttcagggtttagtttttccatgactttccccaaattctaattcctgatgggaagcaaagagtggagaaagttctagctgttcttttagggagttagatgctctccaaaacaggtggactcatctgcttgtgagaacagatgttctcaaagtctttggatccttaccttttaatgacctctcttcatattaccttcccaacctcatcccctgccactctcccagtgctctgcctgcacctcattctccagagggtgcagtacaactaaactgacctctgagtcctagaatcattataaacttttctgtttttcaaaaaatcaagttccctctgctaaagcaccctccatactcatagtccctattgattttacaaagctgagctgaaaggtcatcttcttcatgatgtatctcctgaaatccccatctagaatacatttctccctgttcttcaggcatggggcactttgttaatgcattgctcttgatttatactacactgtgtttttgataatagctatatatgagcagattatttttatacctgtgagaatgtaaaatccatgaaggtaagaatattgtgcaatttgtctgtgatttcccataacactcaacacaccgacttatgagttgcagaattaagaaaatcttgcttgaattgaatctaatgaattgaactaaattttacaaagtggatctgagttaagccccatgaaaatatatttagggatcttatgttcctatttcaattttctacctgtagacagtcctatccatttatgccttgagtgacttagagcaaggtgctttgctgggcattgcggtggaaagaatataggaataaatatgatctctggccctaaggagttgactttctagcaggggagataaactttcaaacagtaactcaagttttaatctggtttttagtcaacaaagaactctgatgattctgtagaagaagtaatccattctactgagaagaagtaagaagaaattaaatgagtaggattgtggaaggtagatgattaaagggtggaagacatttcaggtggagagacgagttgaactctagtcagaaggtgaaactacatgggaatgtttggggaataattgtgagtatgagcagagtaagcaatggaaagagggatgatgttggagatgtgttggaataagagagtaagaccagggtatcctagaattcagatacatggatgctgcacagttgttggcgacccagtttttctagatctgcaaaatatttaacttgagttcttatgtaaatggataaaaggggaaaaactagaattggtatatacaattgtttcaagaagcatcaggaggaaaattccgttcttccttcctgcttgtattattctttgtctcttaattacatgtcaggcattatgctgaattttaaagatagcaagaaaagtgaaacagacatcttgaacctcccgccttgctccagcaaagtttacagtctggtgatagttccagacaaggaaagaacaatgactccatagaggaacaaagccatgacatatggaagcacagaaggctatgacagtaggtgggagggccccttcatctgttcagggctagagagaggggttcaggaatgccacctgtaggaggaaaagtgtttgggctgaacgtgtaggaaataaaaagaagcccttgctctcccattaaaaggaaaaagacatttttctttttctgtgaaagggacagaggcatgcgagggcatggtgccttcaggaaactgcacatgggtagtgtacctagaacccaggacacaaggcaaatacaggcagaagatgaggtgaaagaaacagacacagttttgtcaagataattaaactaacaaatttggcaactgagtcatcccctgtgagtgcagaacacgggtggactatttgggagtgttcagagccttgctgcaacagggtagtccttgagccagaagcatcagcaacagctcccagcttgttagaaatgcagaacctcaggcttaactccagacctgctgaggtttcagaagcactggttgaaggcatggaaacctggctttatatcctggctttgcagtttgccagctgtgtgatcttcgtcctgtcccctgtcttctctgggcggcagtagaatcagccatgaagttgaggaggtggacctagtggattccagtgatatttccagctctaaagagtggtgtgtgtgtgtgtgtgtgtgtgtatttaaatctagaggctattggtggaagagtgccttatttttcaaactggctaacacacaccttggatgacccgctgtttagaattatgccctcaagcctgtgtctaatggagaacagcattagaaaccacaaacttgcacctgaaagcagatcagctggggagctagaaggtcagacccacaggcactcaccacttgtctactgggcttcacagatggaggcaaagaaggggaccccttctgttccttccaccaataatcttgcttccttttcaaggaaaaataatggaaaaaaaaatctaaggggccagatgcagagatatataatcccacaagggcttacctggcttttgggtaagaatatcctagaatttgtgtttctttcacgcgcgcgcgcgcgtgtgtgtgtgtgtgtgtgtgtgttttgcgtgttggggtactggttagggtggcagtgacttaaagcttaaatatcttgattaaaaaaaagaagcttggctgtctggtcatatgatgcataagagctgtgttacattttcacatagcttctccagttgggctatttatttattgattgatttttgggacaaggtctcactctgttgctcaggctacagtgcagtagcatgatcatggctaactgtagcctcgacttccaggactcaagcaaccctcccacctcagcttctagagtagctgggactatgggcatgtgtcaccatgcctggctaattttcgtatttttttgtagaaacaagatttcactatgttgcccaggctggtcttggactcctgggctcaagcgatccacttgcttcagcctctcagtgctgggattacaggtgtgaggcatcgcacctggcccagttggcctatatagaggctacaaaaaatatgctgaaacaggctcctgactaaacaattagagggaatggcggttataaagccaaatcatggccctacctggcagagacacaaaagttaacctggagaagtcgtctccttacttctgaacaggtgtcccattgagaggtgaagaaatcctcaaatagagggaggagatccttgacctggactactacactgagcactgagacctctgacctctgcacagaggctgttgtcatggtattcacgtaaccagtttttcgtgcaagccagccagactcttgtgaatggagagaaagatgaagttccagagaaaacagaccaataacaattatagggggaagcagaagactgaaagtaaggaaacctgaggttctaatcctggcttcacttgtaacttgctttgaaaccttggtaagttcctttttctttctggctcctgttctctatttgaggacaataagaacatcatttattgagtatcaactatgaataagatactacccatttaatgagcatttagtataaataagatagtgtctcatgggtttaaatgtcatctagatgctgtagactagcaaatttctatccccagctaagacttcttctttgaatttgagttgtggacctgtagtcgattttttttttttttttttttttttgagacacagtcttgctctgtcaccaggctggagtgcagtggcatgatctcagttcactataaccttcacctcctgggttcaaacaattcccttgcctcaacctctgagtagctaggactacaagcatgtgccaccaagcccagctatttttttttttttgtattttagtagacagggtttcaccatgttggccaggatggtcttgatctcctgacctagtgatccacctgtcttggcctcccaaagtgctgggattacaggcgagagttcttataattttatgttgtcttggcacccatttaaaatacaagtttaattttttccatcagaagtagggctcagtcatccttgacaaaatttatagttgtacacttccttccagttcctcaatgtggtcaatccaggtacgtgcctgcaatggaaatgacacagcaaaggtggctgcctggacaacagaagcagaccaccacaccaaaatggcccaagccagtggccagagataagaacttagaggcatctttcccacctagcagatgggcttcctgctttcttgtcacttcctttacaggtatcattcagacatttgctcatgaacttaaagtgacccatatcctattccccagtacatacttctctctctctctctctctctctgtctctctctctgcctgattcttcactcctgtcttgcttcctgtgacccagggacagaagattgccttcctgactcaggatctgtaagtaattaatccttgaacttgtttcccattgtggtgtttaattgaatctgtgccttctgtttgaagaagcaggggctatcctaggccctggatgttggggagaacacaagtgcaggctcccagcaccagactgatggtcaggcaggcattaactgcacacaggttagaaaaaccaccaagggtggcagccagtgtaatcaaacttcctgtgtgagggactcctgggtcaccatcagacaaccagatcttagggtgcccaccaggtaaaagaagtatcccatgaagggcacactgtaaacacccacacccagccccactttatttcccattttggcagggttgctagaggttctactactggaaccccaatttagcagggggctcttagatcaggacccaaatgcccattctccattgatgtttagtagtcatcttgaacttacacccaaaacaacactctttatcttcctcacccaaccctgaccttcccactgcatcccctgactcagtaaatagtaactcaatgtgtcccattgttcagactgaaaaatttgggataatctttgactccactctatttcttgcattctattctcagtaataaattctgttgagggtatactcttaaatgtatccagaatctgatcactgttcaccatcttcttctcttacctccatggtccaagccactaccaactcttgcctagattagagtaatagggcctttgaacacccctgaatcaacttaccacacagcagccagaatggtcctattcaaatgcaggtcatagcatgttgcttctttactgagaatctcccaaggactgtccatcttcctcagagtagaatctgaagtccatattatagtatacaaggccctgaggaccaccatgcccccaaacttcttcttctcagctttcttctcctactccccctctttctcactccccatcctggccccactactagtgctaaataaacagcacattaggctgggcgtgatggctcacacgtgtaatcccagcactttgggaggccgaggtgggcggatcatgaagtcaggagttcaagactagcctgaccaacatggtgaaaccccccatctctactaaaaatacaaaaattagcgacgtgtggtgatgcgtgcctgtaatccccgctactcaggaggctgaggcaggagaatcacttgaacctgggaggcggaggttgcagtgagtcgagatcacgccactgactcttttacctccttctgcctggaacacgtccctcggatattgacatggtttattctcccatcttgaggtgtgtgctcaaatgtcatcttctcagagaggcctcccctgaccactttctgtataatgaaactccacccaaactcccagcttagcactccacatgctttgtacatcattcttttcccctacaccggcatctatcatcacctaacagagtcatataatttacctgcttgtttgaccactgcagcactgtcccatagaaattttcagagtgatgaagatattctatatctatgttgtgcaacaatgtagctgctagtgtgtggctatggaacacttgaaatctgggtggtatgactgggaaaatgaatgtttacttttatttaatttcaattaatttaaaataaaatgccacatgtagctagtggctaccatattccacagtgcatgtttagtgtctaccccactagcatgtaagcttcatgagggtggagattttgcatattttgatcactgctgtcttcccaatacctaaaaatatgcctggctactaaagaaatacctgttgagtgaattaatgaatatgctgtgagatttccacacagcttctcattcaatcctaatgacagttttgtgggttggtgctattttcattctcttgtactgaaaggtaggcagtgtcttgctcaagatcacccagctagtaccaagaagataggctctgaatgcagggatatctgaagtgcagacattttgcttgtctggagctaggccagatgttctctgtggtcctttcttactctgagagtctgtggctctctaagaatttccccccttgaaaggcaatggcagcacatacattagtgtttattagattgatgggccttcttattcagccacttgtcaatggctcagaatccatggttctttaggtagagggagcacaatgcctctttcaacccagcctctcccaccttctatccccatcccggctcccatggctcaccggtttctgggtcgcagagctgctcacaggcatctgtcgtcctttgtccacagaggtccctcacccatggggaggtggcattgatctggtaatacagggaaagcttggccgggtttaaccagtcggagatgtccaggtagctcccttcactcaccacgaagctgcttcctatgggtgaacggagagacagatactttcttactgattttaaggtcttagctgatgctacagaacacagaaaggtgtgtacaagccacgttccccaggtcatctgatctcatttgtctaagtgcacttgcaatgtgcccgtcatggtgttgcaagcccatagggagatagaggcaaatcaaacatgggagataattcaacctagtgatgaaagataggcccttaggactgagagggaagtagggtcaaattcagaatctgcccttactaggcattgactttgggcaagtcacaaagtgcccctgggtcttggttacttcctctgtaaaggagaatattaatggaatgtacctcatggagttgataggggaatgaaataaattcatgtagataaaatgctgagctggcacctgacttattataggaaataatgattaaacattaaatttcaaaggaaaagaaaaaagctaatgtccctgtcactcagatgtctcctctggaacaggggtcattgatgtccacaggggccaggtggctaacatcaataggaaagactggctgagtgtgagggaaatagcatccaggcctcctcacctagcttgtgttgtttgtttttgttttattataagaaagacagaaagatatagagagacagactgagatagagaaaacggagacaaagtgagatttccaaagaaatccccagcacctctaaggaaaagagcagcactcacccaagaaaaaaatgccctgatgtggcaaaacaatagggagaaggagaaggtggggtttgggacacaataaacactgtaggctccattaaaatggagcagctatgactcagctccagcagctcttgccacatggaactaaaggctagtggcactagatcttcagattttcttcaggagaagctaaatattaacatttttattattatcaaccaatttttcaacatttctgatggctaacatttcttcttgaatacttgcgtaggccaatatttgctctaaaatgttccttatcccacatatatgtggaaacatacatatattatatagtactatattacatataaatgtataataataatctatgtagatattccacatacatgcacatgttcacacacatatacatacacacacactttttttgggaggcaagaaacagaagcccattcaggatggctgcatgtaagttgcaaatggtgagtgtatgcatgtatagcaataaaacaaaacaaagatagaatttcacagggggaaaaatatgtacccaaacagaaccaggcttcacaaagctggacagggagcgtgagtctagactgatggcagatctagagactgcagcagcaggagactttaaattgtattttataattaacatgactcagcttctctccttgtttctacctcactgtcaagtaaaaacaaagaaacacatctttgtgtatgcaattcaagttctccaaagacagactcagttaataagaatcatatgggttctatggaggtctatctgtcaggtcacatcttactctgctggctgacctatggttggactcctcttggctctggtgcacagctgtggtccaatgagcaatggccagggaggtgggatcacatcagaccacacctggctgtctgagcatctaagactgtgggaggagaagtttccctggaaatagtaagggtatgattggcaatgattatcttctctaattcacacacatcatatgatttctgtcatcctatgcaataaatccctaagtaaaggcacagtggacaacataattttggtgcaaaagaaagaggggtctttgtgaagtaggaggaatagacagtatcaggactgaggtaaggaaatgaccacatttcaagttggccctaaagtccttggcagctaaagcaaaaatggaaggagtttgttggattccatatttcaaatttctggcaggagaagatatgcaaatctatctgcaaagccatatttcccccctggaaataagcccaagcagaaacatgtcacatgggtccttgaggaaggcacagaacatcagtaccaactacagatttttctttaaaaaagcacagtcatgctgtttaaatggataattcttgtatttattctcactaaagactgaaagatggatattgaattgtgtcccagggctgagtttggttaaaccctctacttcaggaaagctacacagtgcagtgataaagagaatagaatcagcaaggtaagagttcatatcctcactttttaacttaccagctctgcaaacttgggcaaaaaaacaaaccctcagttatcatatatgaaaagtgtgataccaattcccttttcatagcttgatataaagattacataagacaatgcatttgtcttaggtcagaatcatcagaaaacagactcagaggcagacacaggcattcaggatgttttggggtacatattcttgtaagaggatgagcaaagtgggattgggcaaaaggagaggtcaaactgacatacagcaaatccctcagctgatcccatggggagatctggggctgggatggtccttcagtgatgttccaaatcaagacaaagatgtcaggactttctatcctcacattggccagtcataagctgtgagctatccctggagaggggacataatcttgtgtgaagtggtccctttcaaaggaaggcatttctcaaaaaaggactcagctgagagtggtcaaccatccacatttctggcagctggggaataagtgcctaggtgctgactggaaacctgagtgcagcatcatgatgtccactacaagctctgtgaaatctcaaggaacaggagctattttggttattattttgaattcttatgaacttagaagctctaaatgcaataccagtaaacagatttctctcaattatgagaaatatgggtttccatgaaagagattggcttgaaagcaggtacaataaatggaaagtttgtgtcctcccaaatccctatgttgaaacctaatccccaatgtggtgatatttggaagtggagtctttgggaggtgattacatgggtggagcccctaaatgggatgagtgtccttatcaaagagactccagagagttccctcactccttccaccatgtgagaacacagggagaagtggccatttgtgaataaggaaatggacccttatcaaacacttaatattttagcaccttgatcttggaatctgcagtctccagaactgtaagaaataaatttctgttgtttataaaccaactgctatagtagactgaacaaactaagacagcagtttatccttaatgtctttaaaaagatattatgcagagttatacatttggtttaatggcagaagggagttactatcctttgaatgtcctctgctcattcgtggcatgaatgtgatatgtattctgctcatttaatccttacaacagcctttcaggataggtatttcttccaattgaacatgaggttcagagagaaattgacatggtcaaatttgcacaaccagtaagtggccaaagtggaacttaaaccaagatttttcagccttcgaagctggaacatttgcctttcttcaagctatcttgaggctcaggggttttggtcagttgctttttatggtccttttcctctgtctagagtagtctgtgaattcctctttagtgcatatcatgtagagttggagggcttttgctttctctcatagaccgtgatttcctacagagaagaggtcatgactcgttagtccttatcaatccaactctcagtaaaatgcctggcacatactaggactttagtgaatgtcaagtgcattaatgaaatcagagttccatgcttgactagagggaagttcaattcacttcatcatggaattgtgaagcagaaatgcctccacgttgatctcacagtttaatttttccatcctgtgagagccagaatacaagactagcccttcagaacctccccagttccaaactaaatgtcgaacatcactatcgtggctcctgagctcttattcacccaatgggctcatgatgcatatggcaaaagtagagaggcaggtagagaaactcagtgacaagggtcaagggaggtgccatatcagagcctgaaaagaagtaactttgtgccaaatttaatgtaaccatttacccaacgttgattaaactccttcctgcgtaagaaatagacatagagactaagaaatgggcttaatccattgagaaagttagggataaaacaagagagatcaaatatctgcccagatatctttaatacaacctacagtgtggtaagaattgcctgaaaaatataggcattgtctttggatataagggagaggaaaaaggggactcaaagaggaacattgaagagttggcctttaagctataccttgaaggatgcaaaggagaccatgacataatgaactgttccctccagagtaagtgggagtaagtggccacctgtgtggcatttaccccttaaggctagactccataactggcctgcactactcttaatctctttattatttgcaaggcactccactcaagtagcacctatatgtgctgtgctagagtgtcattcattcactcagatatggctatgcgccaagccctgcagcaggctctggttgagtaaaatatggcgtctgcctactgagaacttatagcccagaaaggaagatcagatatgaaaaatctaaggcaaagcatgactgtctgctcccctccccccatccctcactttccttacttatttgcccatcagattgtgcatttcttgaaggcaaagcccggcttcatttaactctacaatcactgccatgcttagggtgaagttgaggttcagtgtgggcatgtgagagagaacaagagagaaagagagcactaagtttaaggaatgtctagcagagctctctgaataaattccatttatttgggaatacaaactacacagaaaaggaataaaaggcactattccatgtgtctcatgtttttctagtttttctttggacccttgttttattttttggctttcaattaaaagtgtcctccccactttactgactgttctgagttcctctctacactcatatagatctccccagagagcaatgactctgaaataaatctctgccaaaatctcaacttcaaaatgtcatgtttccttatttttaaatatatatatatatatatatttttttttttctcccacttacttgtgggaatatacatcatctaattagctaaatggattttcagttcagcccaatcatttcgttatctagcatctgaagcccagtgttgctcaggggactgcacgggcacggaggtcctcattaactctgatcttcaattacattgattatcagcctgcttctgtaattgtgcagcatagatcaggggtgagctggggagctcaggccactctgtagcatactctgaaaagccagaggcacatcagccaccaaagaaacagaaggctacagatgagaactaaaaataccacggaaggaggtatcaccagacaaaattgcctggagagccagacagcagctgcaaatccctttcattacacctcacatcatgaaatagacctctgagaaccatggatagatttcaaaagaaggctctggtcacagtggcaaatggtgagcagaataatgaaagatgtgtggctaaaagatggtctttacaaatgaagtgtagagactgttttggtcaaaagttttcatttttattttccctctttctttgggtaaaaataattaaagattccctcccttctgttacatcatgaataccacgggtcctagctgtcttggacctgggagaaatgtcttcctggaaacaagatgaaaaacaaactgtgtgatgaagcaggaatgaagatcatatctactatcagcccgacagacccaagaagaatgtatcacttttacccttctcccaggtccacagagccccaagtcaggctttaatacattccaccacctaccatcaacagaaaactatttacggggtgggtgatagaactgcaaaaatgtggttaaaaacaagcttgagggtttttgagtatgggtaaaggcaacctggatacctgggagaaaacagtctctgagagcaaccactctggaggaacattatcgtgggggtggttctcctacaaggatcttcaagagtcctcctccggttatctctgtcttcacttcctgaccttccactcccagctctttcctctgtcatcttctttccttttgccttggatcaaccccagccttcttctattcttctctatggttcctacttgttatgggttggactgtgttctgccccaaattcatatgctgcagttctaacctctagtgtctcagaatgtgactgtccttgaagacagggtcttcaaagaggtaattcaggttaaatgaggtcattagggcgggtcctatttcaatacgactgatgtccttataagaagaggatattggggcccaggtacacatagaggaatgaccatctgaggacacagggagaggacagccatctacaagccaaggagagaggccccagaagaaaccagctctgctgacaccatgatctcaaacttctaacctccagaaatatgagaaaataaatttctgttgcttaagcaactcaggctatgaaacttttttctttatggcagccctagcaaattacctctatcttatttctttttgtttgttgtttgttgttgttgttgttgttgaaacagctctaactcacccaggctagagtgcagtggtgcgatgactcactgcagcctcgacctccctggctcaggtgatcctcccaccttagcctcccaggtagctaggactacagagacactacaggaccatcacacctgactaattttttgtgtttttttgtagagacaggattttgacatgttgcccaagctggtctcaaactcctgggctcaagcgatccacctgccttggcctctcaaagtgttgggattacaggtgtgaacccctgcccttggccacctctgacttctttgacagcaaatatctcaagcttgccatttgctccacttagtaacctttattttgtgcttgggatacctatgaatcacttctcagaataaagctttcaaatgtataaaaccaaatttatagtataacaaatgtcatgaataagtgaagcacagttctatcaatggaccccctggaggttcatggagctcaggataaaaacccaagtctgaactaagctattttcatccactccccagataccaagtctggtgtcttttctggttccaaacacttccaacatcactggatggacagagggattattataatacccataaagtgtgtgaatcagatggaaatgacaaagcgaagaaagaagctaagaaaatgctgagatgttccagtggttattttaaggacagtcaacctctttctgttaattttacatgaaagtactttttttttcatgctctgaagaagatagcaacttggttaagattggggtttcctggaatcattatacaacagattagaagtttatggtgttatgctagttatatatctaattttacagactatcagaaaaatttgagtctttctagtccagaatctctcaacttttaatatttttatcaagtgtttttagacatttttccttaaccacctcccacccatgaaattttaataccagagatatattgtatatctgcttatacactgtatgtactgtttatatactatgctttcactgtacatagattaaatattttcactccctccccaagatcaatttttacttctttggggatgttatgtccttattgagaatgtatgttataatcagacccttttgcagagataaggaaactgagggtcaaggcaaggggcaggggaggtgcccaagatcccctctgggattagtgaagtagccacagctagaacatggactttgtgactctcaacctcttctggtcatgagggaggtgggagtgagagaagtcaactgactctccaagagccacaggtgtcagggctagaccagaatctaagtgccataacttctaagagctcagagtctgtgccagtatcttccactgacaatcaagaaccgtcctggtggagggaaactgtcactgggctagagcccagtgggagtaggaaatgctaataactgtgagaggaccacttcatagaagagacattgagatctcatcactgcatatcccagaaaaaagaccatggagatgaacagtccactgggatttggggtattctaggttttatatatatatctatatctatatctatctatctatatatatatatatatatatatatatatataacctatatatatgttacatatatataggttatatatatatgttacatatatataggttatatatatatgttatatatataggttatatataggttttatatataggttatatataggttttatatatataggttatatataggttatatatatgttttatatatatatatatgtttttccaaataaagctgtatcaaaatacacctatttccaaatagacatcttcctgaagtgctgtgcccaaatttgctccaggcaaatgtgtgtctactgttttctgtcttccctacctcagacttgtgatcaaagtctggctgaaaacacgttgccacagaattctgcatgcctttatgtatctacggtcttgcttcaaagttgagttaggggtgtttgagtctggacaaaaaaggtttgaagttttgacgtttcaaaaaagtatcttttcccccaagaatacagcagtttggtaccaaactaggcaatgggaaaagaataaagtcatgacatgttttctcatttttctttaatcatttaaatttttaaagaagaattttggctgaaggttgaaagcaactcttttcttttaatttaattctttctttattttttgaactctttttatgacttcattgggaatttaggcatcagacccaattttagtgttggatttcttttttaactaagatctgtgctgtttgaatgaacatggttgacgactactccccaaacccaaaggtgatttagctctgaattcctaatactgaaaaatctctctccatgtcagttgctcaagtaagacacgaacttagatggaaactttgataggagtctaacgggaacagattaaatctggcccagccactgagttgctgtacgattctagaacaaatcacatagtcttggtaagcctcctgcatttcttaatctgtaccatgtgaataatgcttacttcatagagcttctatggaaattaaataagattcatttggatttcctatggatagtaaagttcctggctaaggccttcatgtttttttattgtagggacaaaatgtacatgataaattacacattccatttacaattgtatatctgtctgtatatacaatacatattactatatattttgcatgtgtatatacaattggtaattgtgtatgtccatgtttatgtgcatacacacttgtacatacacataagcacagataattctgtcaataatgtgtcctatatagatggtgtcttctgaaattgtgcaacatggtgatcctccttgggacacagccagatatcagtctcattaaaaaaaaaaaaaagtcaccttgctctcacttacccaggctagactcattttttctaggctgacttatcctagcagcttttcccctgattgtcacaataccctgggatgatcggcgtagggtgggaatgagggaccctacttgaagacatgttgcgagagtgaggaaccactgtggggtcctagaagtatgcctggcatatattaggtgcaatacctttggaatgaaaatttatggtaagacatgaatagctgagtaaattaacaaatgaatgagtgcaccttgtggcctacaggacccaccagcttcactatgctccctgcagcctgtttccacttcttagggtctacccttttgtatgagatgtgcttccttctgcctttcccaagaaatctgcagaaacatcaggagctgtttggaaaagacagctcacaactgtgagcactaagaataaccatattagcaattcttccccaaatctctttcattactacactgtgggttcgatgccaactgaccaaattaggcataggcacctgcctgcttgtgtctcttgtgtcagtgtgtgtatgtttgtaagtgttcctttttctctagatctcttcctttctactctcttctgtctggaattggcttcactggaaaaagcatagaccttgaagtgggcaggcacatctggattcaaatggtgccttgacagttcatcatttgagtgaccctgggaaatgcttgatatttcttttctctgcttgctcatctaaaagagggtgaatagcacttatcttgcagtatttgcaaggtaaatgtaagtctgtgtctgtgcctcactcattgaatgcacatggaaaatgggatttttttttactactgctattgcttagaaataccagtagagggtaggtgttacttttattcccattgtacagacaaggaaattggagctaaaagaggttaactgtacatgtcctaaattgcacagctaggaaactgatgattcaaaattagaatgcaggctacctgactctgactccagagctctgttaacacatggctgcctcgcattctgcttgcttcaaggaaaacctatccacatcactaagatttctggttgttgtatttttctttttcgcttctgtcaacatacatctctcattacttctgtaaatactgagcttctcatggtggtagctggaacataaatcataccatgttgaaagagagggagaaaaaaaaacaaagaagtcagggagaaggtgacataatattgtaattcaatacttaatatctccaaagacatgtaatacatcgtcatgacattttcaggagatattttctggaaattggacaataattcaaattaatgctaagcctaaatctaattattttatgatgctacaaaggactacatggggccaagcatccaaaaatcagcggtttcaacagtcatgttgatgaaacaaatttcactgccaggcacggatgagaacagctgcctaaatatacaatattaatacctggggcaatgtaataacagggaactgcagcctagccacactgtagccttctcagcaaccagcctttcaccagccaagtcctactatgaattctgggaaaggtaaggagataaaaaaataaggtttttattcgagggccaaatgaaggccctggggatcaaataggacccagggtggctgaggtccacgtttctggtatatgtcgcatgaaaggtgaattcccgtcttctgttcctggaggcagctggtgaaatgtagtctgaaggagccagtccctggagccagagaagactggttggaacaccagccttgccatttaccacctgaaggactttatgcctatgattcactctgtgaaccttgcggattctcttctgtaaaatgggacaacaatacctaacatataactcctgtgtgtaatggcacattgagatgtccatggttcatgaaggaagcaagttgcccgaaaatagataaagtatcatctcagatttgaaataaacaaacataaaaatagccattcagggtttctgtgtgtgtgtgtgtgtgtgtgtgtgtgtgtgtgtgtgtgtgtatgtgtgtgtgtgtagcaaaaattctagaaggaaatacatcaaaagggtaatcaactgggcagactaggattggaaatatcctaggaataggaaagagggtatatttaatatgtgcttcatttacacctatattacctttgtaataaggatactgatgatggtactattactagtacttctatgatattgaaaacagcaataacaccaacttcagaagatttgggaaggaagaaagggtagaatatatacaaattgtagtagtgagtcaaacacatagaaggtgatgaaaaattgcttttttttttttggtctctagctaattgccaagaatatgttctccctctgttggaagagtctgaggcactgggccaagataggtggaaattgactaaataatgccactttcttcttctcactcttgcctttgtcctcatatcctgaagtttcctccttactacccgtatcttcccagattatactcatttatcttccttccctggtcccatcacctggaagtagcctgtccttcctctgtcctgaagcctgctacacgcatctcttttcttatatcggtatcaccactgatgcatttgaatttagcccacactttcagaggagtcagcatgtggcaagatttagggcatgctggtgtctcatctacctagggagagagtgagttttctaaggaagaatccatatctaattcatctttaaaatggcatctctaagcacagcgtttggcccttagcgtgcaatcagtaaagcattttgaatgaatgaatgaatggagtgacaaatggtgctttaaggcaactatttgcagaatattgccatagatgttatcaaacggaaacaaaagagacaaaccccacagttccctccccacactctccagtggcgcttcaggttggggtgcagtggagcaatcatctctcaatgcagccttgaactcctgggcttaagcaactgtcccacctcagcctccttagtagctgggactacaggtacatgcaacaatgcctggctaacttttaaattttttgtagagatgaggtattcctatgttgcccaggttggtcttgaacacctgaactcaagcaatcctcctgtcttggcctcctaaagtgttgggattgcaggtgtgagccaccatgctgagcctttttttaaatgtgaagtttctgacatagaaaataggttgggttctattttcagttggaaccaatggtctagcaaatgatgagctaaactatgggatacataggacatttggagtgtatttatgcttttgctatcaaacctaattgtcctttctgaggtgctaatatctggaagagcacagctaaatagccaaaccatggtttatgaatccagaccaaaccccatggggcattcttggggtttacacaacaggaatgggcatgcgcagagaccctataaaagatcaaacaaagttaacatcatctcgctctttcaaaaaactagtcaactgctattctttgttgttgtcaaattcatttagatgaggaagtctttctgttttttataaacagagagtccagggtaatgtttaatagcagaaatacagagcgaggcagctggtattcacgttctggccatgccactaactaaccaaatgataatgatccagttaaatgggccttggttcctcagctataaaaatttggataacaatctcacaggaatgtgggaggtaatacatgtaaattaaatttcccttgtttcagattactcacttttagtataaacgaggtaatagatgtaaagtgcttaaaactgcacccgacacataataaatgctggataaatattagctattcttacactatttctacctacatatatttgatagttctactgtgaaataaaagaaaatgttgccttgttcaaatacagtttcgcaaaaacaaacacaataaccaagactcctgcttgaacaacatattagctttggatatagcagtgtaatcaaaagcccattctgtgactcatttctactttcctaattgcctgttcctgctctggtcctcagccaggagtcagtctttagccacacatggatatatacacatcagattgtgtgtgtgcataaacaagaacacacaactcctgctgcctctgaggactgcaaagaaatgacattaaaagtgagtgatttgaaacaactgaaatttaattaaaaacaaaattaaaagttgttccaagcctggcgcttcagccagcaagactcagaggaaattagtaagtgctactaatagctggatccaattcacaacctctatgagaagacagtcagagcaaagaagatgcataccctttagatgaaacaattaaagatcacttctgagaaatagtcatgtacagtatcccagggcaaaaaaaaaaaacaaaaaaacaaaaaacaaaaaaacaacatcatttgctgatgtgttcctctttgaattcctcatttctattaagggaaagtgccctgagattctcctagtagcatcttcaatggcaacgcactgattttgaaaactagacttaacacgggaggtgggggcaaattcctttaaaaaatgttgtcatccactgtcctgaaatttcaccttgcaaatttattcatcctttgaaattccaaatagtcaaggtgcttagtaaaatggattctcctcaaataatgaagacgattgtcagctgggagttggggactcagcagcaggatagttaaatgtgctggctgcaagagtgctatggtggatggaatcagagtgggcagtgggcagtgggcagaggggctgcgtctgagatgaatgctcagaggcaggtctgagaagaccacctgtcccgggttctcagggtagcatggagagaggtacaggagaaacagcaaaaactatgacagtaaacaggaagatagtgaaaacaaatcaaacaaacatacgacaacaacaacaacaaaactgaagacaataaatgagaggggtggggtaaaggaagggggaggaatgactaaagctgtggcattgaaagtcttcatgagcattaactggccaggagtggaatgaaccagcttagcctaaatacacaaaattggagcagacagtacaggtccctgaatcaaagaatactgctcagagctctaccttgctctactttcctccgtgtccttgtccacagaaaggaaagagaatgcccattccacagaaaagctttcctgtgctcacttctacaactcatcacccagtctgccccaaccacattgaccttgttccaccttgttcaagtcacccaaatggttttgactgtgttgtttcctctgcctggaacacactttcctctaccacacaacttcacatgttcctttaaatgtcgttttctcagagagatcttccctgaccagcatatctgagccttctatcccaactctcctctattttaattattttacaccattttaattatcctcacagccactctcacctgttgccaatgcttacttactttattttgctaatttgctttggtgttcgtctcctgctgagaatgaaagcatgctgcaggcaggggctgtgtcttttccagcacagcatcttgactgccccatgacacataagaaacaggaaataaatatttgttcaatgaatgaataaattctgtaaagattaaaaaaggtattataggtagaatacctagcatactgcctggcacatgatgaattctagctgttattttcataaggatctaatattatatggatttgcattctagtggtgaggttgtttccggaaggagagaaggatggggactgaaataggactggaggcctctagatgccaacttgctgtcctcacactgtgtttggaacatgcaatatggcataagcacgcacctgttgtctagatggatcttactgagggtgcgaggttggggaggggatgggactgggcgctactgagggctgatgctgcaggtcaactagggagagaggagaagctgaggccaatttccttttgcacaaaccagtctcatcccatcctcaaacgagttcttcaaggtggacaatgaatctgtccaagcccaacttacccttttatgctcatctcagcttctaccttctctaagaatcttttgatgtctacctcagtgagaattaccttctctatcttctacccaactcctcatgtagctttgagagcaatgcagcttatgtttactgggctcaagactggttttgaagagtctacctcattgtcaaatcttgtgacgtaattttgggtttcaaaataaaattgcaaccaataattcaataacaggaatcataattacaggaacggtattagatgtctcagaattgtttttttttaaaaagttattgttaaaagtatcctgaatagggaacagatctaaatatactgagctcccactctatgttgaataccgtgacaaaagggggtggttataaaagtggaagaaagagtccctgcccgaaagtagtgtatggttcaattgagagatgacaagatagaccattataatagaacataatcagtgtagtgataaagataaaacaggaagctttgggcacacagagcagggatgctcacctcctctgcaaagtcagagaatgcttcctacaaacggtcacacttgagctgtcacacttccttatattgagttcaatataagaaagcagctaaatggagtagaggggtgctatgctttggctgtgtccacacccaaatctcatcttgaactgtagctcccataattcccatatgttgtgggagggacctggtgggagataattgaattatgggcagtttcccccatactgttctcatggtagtgaataagtctcatgagatctgatggttataaggggaaagccctttcatttagttctcattctctttcctgccaccatgtaagatgtgacttgctcctccttgccttctgccatgattgtgaggcctccccagccatgtggaactgtgagtcaaacctccttcctctaggattaccgagtctcgggtatatctttattagtagcgtgagaacagactaatacaagcggcaaagggatttaggcaaaaggaaagaaatgctgcaaagaaacaaaacagagtctgggccttcaggaaatagctatttcatttggcctgaggatgagatgcccaaggaggagaatgggctaagattaggctcaaaatagtttctggctctaacattctacactttagaaaactgccaactagctacttggcaatatgcccacaatgtgccctcacccctgtactcatgcccccccttttggggtagcagaagctgccatctttaattgattccacatttcaagtgtgacaccagctcccatcaccaggcctctgtatcttttttcaggcctctgcttccatagaaagtccactgcccagcacattaatgcttcatttgagtctttgcagggaatggctggccctggaaccttgaaactcataggtcatgttaacactcatgtgggtgccacagactgatcactctctcatcctccaccctggttcaaatactgcagtgagatgtcacctgagatattactccagtgattcaaaccttcaggggagcagccttcagagatccggcaaattaattttactcgcaggacacagtgacatctcctactaataacttttatccaggcagcatttgtaaaggttctaatattgtggtttttcttttttcttttcttttctttttttttttttgacagagtctcgctctgttgcccaggctggagtgcagtcgcgtgatcttggctcactgcaccctccacctcccaggttcaagtgattctcctgcctcagcctcctgagtagctggactattttttgtatttttagtagagacagggtttcactgtgttggtcaggctggtctcgaactcctgacctcaagtattctgcccacctcagcctcccaaagtgttgggattacaggcatgagccaccatgcccagcctattgtgtgttctttaaagttgcttgtatttttttcttttctttcttttttttttaaatctaaatatgtagccaagaagtaggcatctgatctttggtctcacatcgggatgctggtgcttcagcggaattgtaacagtccctagtttttgagtgtggttaccatgggccaggcccttgaaatgaacaaccatttagttctcacaataacagtctaatttctggtgttttagcatccccatttttcagaagatgaagcttagttaggatttgaacccatgtactctggcattggtgttgaagctcataaccaccacacctcacagctttacaaaaaggggattattcttacaaggcttcctcaactcaattgggcttcttatgttgattgatgtctggggtcatcaacctttcagggatcccaggtggcagatgccacatcatctttgactcttcctcttccttggtctctacttgtagttagttgctatatttcctttttctagctctacaggaactcttttttctttattttcacatttaatgcccttgttcaggcattatcttatgaactcaatatggcagcgcctatcaggttccttgtcgccagcttaggcaacctcagattcacctttcacattgtgatcagtcattaaacaaatctttattgaacactgattgtgtactggggattacaaaggaacaagacagctacactctctgccaataagggccttaaagtagctttggaaggggctattgttttccaagtatggaatatgtgctacgcaagatcaccctttaaggtggtttactgtgacattccccatttcacagatgcacaaacgaggcttagagaggttaaataacttaaggctacatagctacaaaatatcagaggcaggtatcaaactctggcagtgagattctgtagcccagactcttaaccaaattagacattgaagaagtaattgcaaatgtactgaatgcaaaaagtagtagttcaggaccatttaacaaggagactcgacttagactgaaaggacggtgatggcaattccaataaaaatgaacattaccaagtactttagaaatataatctcatttgattctcccaaccctacagattaagaaataacccagaagggttaagtaacactggtagcatctattatctattatttcatgcagctagcatttgaacctaggtatgtctgactccacagcctgaactctgaattaacaagctgccttgccctttgtaaaagcaactgtgactcttccactccttttattaaaatccttcagtgcttccataactcccaacctccaggataaaatcccaactgctcttcctgggtaaaccctcccattagatccattcatgcccccatggagccccagccttgctgggtgctacctgctcctgccacacctttgctcatgctgttctctttacctggaagattgcccttcttgtcctccctctctccccccacctccaacagaagtgcacattctcactcccaatccctgcccatccagtttcctcaaatgggaaaagatgctagcagaatcctcttgctccttgaagctttacccagatctgcccagtggaaaagactccaagcttccctgacaacctggctgactcctgtctatatgtcctgatggttcagattatcatctaccttccatagtagccttttgctatatagttatcctaacattttaaatgacacatgtgatccctgtgagggtgtgattggcattttctaaccacctatttttggctattgttatgccactctctatttcaccctcaccaccaccctgtgaagtaggggcttatagcttcactttaatagatggtaaaattggtggttctgagaagtacagtgactcgtccaagatccataattagtaagtggaggagtgtagatttaaacctgaggatttaagattccaaatcccatgttctttcccccacctcacccacctttaatgctgactgtgcctgagttaatcccagaatctaagtctggccctgagcaggcactcagcaaatgtcagctgaaagtttgaatgtacagactcactgataaagtttaaatggaagccagagttaaagccagggagtgaataaacagaaggttcaaggatggtccaggctctggggatcactccagctgatgatgagatgccccagccattagctgaggttcagaaagttgccaagagcttctggaaaacccaaggctgagcagctgcagatatatttggcttacataatccagaggaatgtgctggggagaaaagccaaatagcaaggctttgctgggtagcagcgctggggaagggggagcaggatgcacaggtgttaattattcctcccatcttatcctttcccatgtgaatacaatgcattcttcccctcccagactcccactggcatcagagatgctcaaggtccctcttcagctggggctgagaggggaagctgcggaggggccaggcttcccactactttatttttcatccaggcagccttgggagcctgaagtccctccacaagcttggatgtgatccttctaagctgtcttcaaatggcaacttgtgggctcagctgtttgctcagctgtctctgctccctacctccctgttcagggggctgcatgacagcagtttggcccaaagcagtctgaagacagagtacctgggacactaatgtgatggctgcataaggacttggaaggtcatgtccatcatgagataagtaaaaagggactttgaaccccagtatttctccctctccatttaagatactggggcagggaagaatcttaagtaccaccttgttcccctcctacattttacaatgaagaaactgaggcctgaagaagtagagatttgtccaaagatggagtgaattcatagaggagctggaggatgatcttagtcatcaaattctctatcacattctgtggatgttgattcaaaataattctgttcaacctcttcccacctgtgtaacactaagatggtcatataacctccctaggcatacatgacctttcaatttttatgtgtcccttaaatttgaggataataactggatctacttcatgaggtaatagaatgaaacaaggtaataccttgcaaagtacttagcacaggacctggcacttagcaactcttccgtaaacatttctaatcattaccagtgttattgcaaccattgggaggtttgaaaaacaggatctataggatgcactgacatgtgtccatgcccctccctgggaagcctgcaatcatccattgcccttctccagataagtgtcaatggctctaagatgtagctcaagtagcacctccttaagacaccttcttcccatctccagcttgggatacttgtgtgcccatcggtgtctccacagcatctaggacaatcccattatgaatcattcacactgagtcatcatttattgacttggcatgtcccaccaccactaagctggagaaggccggagatggtgttttatctgtctctccaccccagtatctgagcatgccacagagagtatggtatgcaaacgtttgttgaccatgggaggaaaaaaaaatgaaggagaaaaggaaggaagaaagggaagaagcagaacactatataagaataaaagagtggtgttattaatgcattttaactatctatcttccttcttctagccaagggaggccaacccccctaatattctaccttttccttacctagccttacctgccaagaccctattccaaccctaaggttttctttatacatattaaagctgcaaacagtgaggaaaagtcacaacattctcataatcataactaccctcacagttgacaaaatacttttaaatgaatcagcccactaatactctttgaaggagggagtattagcatgtttttagatttaaaaaaaacgctgaagtttaggaggggaattaatatacccaaggtcacaaaactagaaagcagatgaacaggtctggaatgcacatctcctgggccacagatcaatccacttaatgtctttaccatactaccttctttctcctgtggattactccactgcctcattatacactatttggcaaaccttaagccaataattatggaacaactaactctatagacttgaagtcaatctcatcaaagctcccacccagcattctctctttccgttctaaaagtcaaagtggccttctgttcacaacaacagaacggaattattaatgagagaaaattgagtttgcctactccttgcaacaaccctctgccccagttcctgggaacatatttttggactcaatctgctatcaaaacacagaaattagtctccaattttggacgtcaaactcagttatctcttttgttatgaaggaaaattagtaatgattcattctggttggaagccaagctaacatcttagcacagagtgtcattaaaaatcccagtcccactggctgctgtggtatctttaaaagcttgaacatgttcagctgcttagaatggtttttctgggtttgttctcccccaagccacttgtcattttaacctggggatcagttactatttaaggcagaaaatggcttaaattttttttcttccatggttttatggatttagacattcctaatgaagagatttgaagaaaaaaaaaaaagaattctactctagggggtatccacagctcccagccattgccgagcaagttggccattaagtacaagaaaaagaagaagtgaaaaaaagttttcacagtttataattatattaccaatttcattacagatctcattttaattctgactgaagcctagccttgccttctccctgtactctctcacgtatagttattaagtctgggttggagttcaagctattctccctgatttcagcatattaatatggtttattggtatttcattgccacctcccctatgggggttctgaatctcagcccaatttatatttcccctctttctgggctctgggatgaagcttgtttcattttggtgttgaggaggggtgtgtgaatttgattggagtttatttttggggatgggagcaacatccttggggagtgaagtcaatcatagaagaagaggcagcctcagacctcctgcactgtcattctttttgatgtatcttcttagggcttctgggtccaccgtcggtcctcccttacttcgttttttacagacacaatttcttatatgcctactgagtcagaatccctgttaggcatcacaataagttagaacatgaataagctgtggtccttgcccttgaaaaaatttaagtctaaccattgaattaactttacaaaaaaattcagtgaaagccttttagcgggcatcaagtatgttttggatcctgtccaaggttctgaacataatgtgcaaaacaaatgtaatctctatccttatggaacttgaaacctagcaagagagaacaacattaactagataaatttaaaattatacattgaaataaatataatacagaaaaaaagcagggctcaaggagaatgattcataagggagctaacagaggcattaccctagggtaaatgagagaaactagagatgtgggaagaagttttcaggcaaagaaaacaccatgtgcaaagggcctgaggcaggaggcaacagagaaatttaagagccaatatatggagaggtggtgtgacgtaagactggaaaggcgggcaggggcctgaccttgcaaggatgcaaaggccacaataagaagttcagtcttcaaaacaagtaaaaaagaagacaataaacagatttatggaaagtatgacacgtatgtaatacatgtatgcgatgttttgatattttcattgtaaaagatggctctgtttgcattgttaataaaagataggagagagcctagacttaaagcaggaggccagttttcaggactgtggcagttgtctcaatgacacatatgtaacagtaacagtaacagtaataggagttagactgaagtcattagaaaggcacaaatataattctaggtaatgttcatgagaggtgatattatttgtctctaaggattcattgaagaaggttttctagaggagggagcaaactaagttatgccttagagatgggtgagactgccatatatggaaatatatgatggagaggaatgtacaagcaaaggtatatagagaggcagataccaggtaggacagtctatttgtctaaacagcatcaaggctgtgcaaatgagttaacaaagaaaaagacagaagccatattgtacagaacttccacccataagcatgttccacagtattcaaagatctgcagtcaacatggagcattttaaaacaaagcctgggatgatttcatagagcaggatgtccaaggaactactcgttttaaataaagtgcttggcagtttgtggctaaggatccacttacaatgtggtgtcattttcccttctaagaattgaaaatactccttccatgtattcaaatcactgcaaactagttctgaagccaattatggacctctttcctctctaacagcacaaagtcatgcattagctcactcttctgggatggaggacatcaagtagggatgagagcaaataaatgtagacaagtgttattattcacaattttatgctcaaaaccagctacatgtgtggcatattagtgaaccatgccatcccaatgtgtgggcatttatacttgatgatttcatgggctaagaagccatactcagatcccaaatatctcagtcatagggaacagagaagacttggatatcaacttagttcaacctaaaagatgatgttaaccatttaaaataacctgaataaaaagacattttagcataggtattttgatgcaacaatcatatcaatatataaaattgtgtgtgtctgtgagtttagctaagtaacatattcaagagacacagacatcccttgttttcacccatttctgagcctacgcaaagaattggtgacactctgtgtgaagtactaaggaataaagaaacatattctaaaagtcctaaaaaattaagtggttttaaaatttacagtttgataatatggctccaaaacaaaatatcatgattcaaaccaaacgcttctcttcccctctcttctacagctttgtaaaaatgtggtcatctattctcaggagattttctatgatggggaactcattaccctgcaatgacccccttccaatattaagaaaatattattactacttctaacatttatataatttattgaaccattactaggtcttaggtattgagctaaaagctttatgagcattatttcacttattcttagcaataactttataagtactgctattatccccaatttatagataatgtaactgaagcttaaaatgtttaagtaactagcacaagtcacacagtcaacagtagaggaagacgtttccaaaccaaggcttcatcttctcccatccctgaccatactcattacccatatatctgtctagttttgcttccttaggacttccagaactagcctgctctcttcaaaataaataataattatcctggtctcctctctggaagcttagagcatagaagaaccttagactgggggctcaggtaggcttaagttttcataccacgtcatctatgtgttaatctcgtaaaaccacctagcatccctgagccccacttttcacgtacgcaaaatgaggatactaaatccagactctcaattttgctatgagaactgaaggaagaaccctgtgtaaagtgctttgtgtgctactcaatagataacagacatgctcaataatagtaggttcccttcctgtctaggttccttcaacgcttgttattgaatgaatgtcttccatcctttccttaagaggtcattaggtatctacagtgctttttcaatcttgtggctgccaaatcctctcacttgaataacttccaatgtataacaagtcttggaacaaaacagggaattctaggtggactgttacctgcctacactggagtggaaccatctcacctacttcacctagatagcttgttcctttaaaagcagactcttctattggctgaccacattgggtgaatatatgcccacttacattgggaacctcagtagatgcataaactagcatctcagctaagataggtgtttaatattaaccaataactatttctcaatgaggctaactgcatggcaattttgatgaggtccaaacctgtgtgatcagggttagtatgttataaaccttaagaatagaccactcacattatatccaatgctaatgatagttactggagttatgctatgaggcagctccattagtagggcattgataaagtcaaaggtggaggaaaccaaagacccttattaaagatgcttataatgattccaaggagtctgaagaagtgatcacatatgttagatggaaaaaaagtaacacttaaagaattattgacacagctctcgaagccttgataagtgaccacctagagagttcttgtaaagaatattaatatgtgggctctaccctcagagaatctgactcactggttctgggaattatctccccagataacctaaatgcagacgatttgtagttcacagctggataaacaacactagcttaagtctgtttagatgcaaacatgttccatttcttcagtgtgtgcttaggagggcaaaaagccactgatggctttgaagaagcccagataaaagaaggggtgagatttgccaagggtttggataggaactgtgtcagaactcttgccagctgggctctggacaagtgctatgtcataatgaccttttctttataatcgacagtaaacattgagtataactatgcagtaacacaagggcagaattcattttctcctggaagacaggacccattactcagccccatccaatgatccagcaccacggacagctcaatgtgtaatggtagctgagagctctctctactaagaagggccagcacctgggcagcttggaactcatgggggtgactgaaaaaggatgaaagctgctctggctttggtccctgggagacctggtctcaaatggagcttcttgcacttgacatgagctgccctcatcctgacagacctcattgagactttgtttttcttgttttttaaaactttgccagttttaaggggccagtattatgatgtgggtgaatacatatatgtaaaatatcatagaattgtgcactttccatctgtgtttgtcaccacatttatgttaggttgtaacacatttataaatatcaatgctaacggatgacatgggttcaagaaaataggcactattatcgctttccctctcatccccctatgtaataccctcatatctccagaaatcagagctggaaactccagtagtacaatttataaaatcaattttctagatccttctctactcctacagaagatttgattctactccccttcatatcccagtttctgtatctgccaaaggtggataataaagaccactttggagagctgttggaggaatgagatgagcagcactgatagagtttctgccaaaggaggcattgggatcatgctggggaaggtgagcttgattgggattaccagacagccatccacctggcttcaaatgctggatgctcccaggattcctgccaagccccagagatggaggagtttcaagtgttaacgtcttcaagtgggaaagtcacttttggctggaacagagcatataatgtattcccttttccattcacctcactgagagtagctaaattcacctatttagttttctatattttcttgccttgccatattccagcttctgaagtctctttctctacaaactgttttaataataagagtaataacagctaccatttgttgggctatcacaatgttttagacactctactaggcactttatacacattataacgttcaatcatcccataataatccttattttacagataggtgagaaaaatgagactcagatagctaacttgactcttctatgtttcacagtaactaagcaacaaaattgagatccaaaccaaaacttacttcatttgaaaggacacattcctaccaagatattatggcatgtaagggatggagattccattatgcctggagactaagatactgtggacaaggtcttcccaatgctgtcttctaagcttgctccatcgcatctccaggatgtgtatactccgtagttatttctctttttcttttgtattaattatattttcttattttctggatgcttgatgctctggcatctgagcctcctgactggggagaaccctcccctccaaggatagtcatatcttacagaaagcaaaagacttgtccagggagcatccctttcatatgaaaattaaccaatccagaacctacactccaatcatctcctctatatggcttatacacattgggaaggaatattctctcccttcatccccccagggccagataccaggcaatcaggagcagttctgaaaccccagagcctgctaaagttattcaaattggccaatctcaaatctgtctatcctgcttacactgcctcacccatttcttcctgcaataaccataatacaggctctttcccctgctttccacttggtccctctgcctgctgatagatacgggtgctttcccacatggtctgcatggtgtgctgtgcattgtgtatctgagatctgttagtatgaaaactgcttgtttcacaacagtcctttcggcatctgcagacaaatcctgggtacattttaaaacttcacaggtatattttaaaacatcttgatttctatgcatcatctgccttagttttccttgattcagtatctgttgtgtgcttagagatctaccagaaggattctatagaacaatgaacaactcagctttaattcaggcaacattcatccactggacacatatttgctgaatatccattatggacaaggcactgtgcttatcaatgggaatataatatttctccccaaagacataattcctgccctcacagagattccagtctagaggcagaaacagacaattccacaggctgctataaaattttaagtttatgacattgggcacaccgagaaagggcaccttttaattcaccacattttggtctatccttccaaatcatcaagacggtttgccgctgtctcgggtaatcccttgattttgctatttcccagctgttcaccatttctcagccacatgctgtctgaaaatctgatgaccatgataaaaaagtaggtgttgtagtcttcagaatactcctatgaggtaggtactactattatccacattttatagatggagagacagaggctcagagaggggaattcacttggctatcgaagaggcagacaaaggagcaagtatttagattaatgtttgtagtattccaaagcctgtgctcttagccattaaactgtttcatcttgagcaagttattttctcagggattccatttctacatgtatgaaaataaatatgtaaaacttgaaagcctttaaggcttaacattctacaattaatgtgtagtgacagctgagagatgaagggtggggacatgcattctgtagaatttaatacttgctctgttgtttttttccacctcagtgttcatcactcctactcctccattgccattttctggccacttccaggttctgacaattcttctagctgcgtaatccatcaaactatttgcttctgtaaattttgttccttctgatttcctacagctttccctgccatctcccccaccacacatttacttgtcttatgtgcacatatgactcactaaagatgagccaaagtcttgtacataggtctgaaaatcaactgaatgtaaatgaaataagagatataagttctgaatgtatatgaactgatttgcagtccaagtgaaaaacaagtaggggcttctgcactacggtgaagtgggaacaatcaggatgcattaatagaagtttgagtgtttcagagaatggtggtaaaattccacttttctctggtcaaaatatactgaagggatggtgctaagttctgaataccgaaacttaacggaaataaaatcaaatttcactgaagaaagactggcaaatagagggtaaggatctcaaaaacgttctatacatatcaaaatgcaaaatttttttaaagaattaatggtactaatatggtgctacaagtcagaaagtttattgcgtctacagagcactaactggaaggaggcacaaggaaaccatatgaggtgctggaaatattctatgattttatctgtgtagattcatatggaatcttgttacatgtccttatcacaaaaaaattatagtgagaagacacttttagaggtgatggctacgtttatggcattccttatggtgatgatttcatgggtatttacttatcttcaaactcatcgagacatatatattttaaaaagtgtaaaatgtatacaatttttaaagggtaaaaagttctaaaactaaaaatttattaagttgcacagttaaggtatgccttctttattataattatgccaaacttcaatacagctaaagacggtgatggcatgtgagaagtgtttgagaaacagacgccaacatatcctggaatgtgtaaactgggacaacttttctggagggcactttagcaatagatagtaaccaccttaatcagggtcttggaccatgctttgctaatgactatggtggcaacagtgtctcattaattcaatttaattgggtgaaaagtaaatgctagaatataagacacttgtatatttacagggaatgagcatatgaatattatccaagacattcaggaaattccaataaaactcatacagtcttccttgtcatatgattctaattagcaaatactctttggggggcatttttattttgaaatggatccacagtcataaatgtcagtaggttctctgaagtagctcaatctttctgtattcacatttgaattcttcctttatttttaaaactttatcgttgctcataagttaaaagtagtctttactggataaagaaaatgtggtacacacacaccatggaatactatgaagccataaaaaggaatgagttcatgtcctttgtagggacatggataaaactggaaaccatcatcctcaacaaactaacacaggaacagaaaaccaaacaccacatgttctcactcataagtgggagctgaacaatgagaacacatggacacagggaggggaacatcacacattggggcctgttgggggttggggagaaaggggatggagagcattagcacaaatacctgaagcatgcggggcttaaaagctagatgatgggttgataggtgcagcaaaccaccatggcacatgtatacctgtgcaacaaacctgcatgttcagcacatgtatccccaaacttagagtaaaaggaaaaaaaaattaaaaaaaataaaagcagtctttaatttaattcaaataatccagattacaaaggataagatcctcttccaaggtctttagatgctcctttttttcctcctgtaatatatgtaatagtaattctaaggtttggccatacacagaaacctttgaccagtcaggggtgcaaggtgctgagtgggtgtggagcatctgcaatgctcggctcttaccatctgctatgaagtgctcgggcacatgcagagtcaccttcacagtgagtggacaagacatctggctgccacacaccatggccaggatgcaggaactcacagcaatcagtgtcagggctgtcttgttcactgggcttttcagcaaacctggtaacaagaacatacacaaagacacaaaattccatgaggtgaggaaatgggattggcatcaagtttgggaattctattattttccagttgggaatctgaaaaaagaaaagaaaagaaaaaagacatgttttctaacctttgtgcctgctatgacacctcagtgggccttctttgggccttgatttaacactccgcaaaatgggcttcttatgattcctttgggtaagcataaaagaaacaggctttctgaaactcatggcaattttcactcctcccttcccaattcggttggtcattcttgataacaattagatgatattaagccctccattctccttagaggcaagtgagaagataccatgctgttaaattcagtagagtctagtgaaataagcatgggctttggagttagatcattctggattcaaatttgggctttggccctcattggctctgtgatctccattttccaaacctcagtttctttctttctttttcttttttgtttgaggcggagtctcgctttgtcgcccaggctagagtgcagtggcacaatctcggctcactgtaacctccgccacacgggttcaagtgattctcccacttcagcctcctgagtagctgggattacaggcacccaccaccaagcccagctaatttttgtatttttagtagagacgggttttcaccatgttggccaggctggtctggaactcctgaccacaggtgatccacccgcctcagcctcccaaagtgctgggattacaggcataagccaccacttcagtttctttatatataacacgaagataataaatatctcacagggttcttgtgacaattacacagcatgatttgtatatcatgcctgtcatttagaagagtttcacggttagaagctgatcagttcaaatgaatttcacaagcgtttactgagcagctactatgtgagacacatacagagcagaagaataatctttcctcttcaggattttataggctagggggaaaagtcaagcttatccatagctaattagattctaacacaaattgtgttacgacctagaagagagggcagagagtacggggggtggttttgcctctgaaaattaaagacaattttatggatataatacgaaaagtagattggatctgcacagctagacgacactgggccaacaaagaaattctatggaggctgtcttgagtccccgtttgtttctcattctttaggctttgttcttcaaggttttgcttaccagttttagagcaatgcctccacaatttttttttttactgctaggctcttcttttaagcaaaccttgtctctcatctcctggatatctttctgtggctatccaattagaatgtcaaatatattaataacacgttcaaaacagggtacattatcttctccttaaagcctccccctcctgagatcctcagcttattgaaagcactgccatttagactggccagaaactgagatgtcacctttgagtttctgtcttcctcctttacagcatctgaagagttgtgtagtgctatttattctatgtcctcagcattttcacctcttcccttcatctcttctattgtatgtttgcttgtgggataagggaggtgcacgcatatctgttcactgcactccctgctgaaacctctcaagctgttttacagcatctggttgcaggatgtgatccatattcattagactggcatccaaggcctttcatgaagactcccaacactcatacctcctgtgctctggcctaaagactagcagggctgaattactgcagtgctcctaccattaacactcttcatcatgttaacattagtgcaggtgtttttccttttggatagaaatccacttgtttccttgtcaccccatcactctttgagactcaccatatataaagatttcatatgctcttggtagataaactacccatattcattgtgtttcccctcataccttattccaaacactagagtctagtaaatagacagccaactccttgaaggcaagcagcgtcttttgcttaccattatgtcccagtaaatagcacagtgactggctcattgcagaatctcagtaagtgcatgatgactcccataaatgacagtaacaatattaaaaaccaacataacatagatgctgaccaaccaaaaagcatgctagccaacatccaacactggccatacaacagaacatcggctattattctgttgtaacattggattacaacagaacaagaaccgttacaacagcccgttggggtattgcctgtatggaaatctatttttcttaataaacagtgacctgcttgaaggagaagatcccaccttcatcatctttgtgtttcttatgccaaaatcaccacctggaacccagaagttacttaatttaagaacaagacccttgtcttttttctcagtcctaggacaatgcatggcttatggtaggaactatacatgagattgtggttattgtagttttagaataaatgttaaatagaagagtaaattaaattacataaaaaggtgattccagtgtccaaagatggggaatctctaaaacctaaaataactacagagaaaaatgaacatgattatctcttattcgagtgctgcaagaagctgtttcatacatatttataatatttataaatataaatagataaaatatgtatagtataaatcttttagcaactaaatagcataaacaatctaacatcaacgttatctactaaaaagaatatggaccaggggttggcaccttgcattgacctcaccttaaaacgtcaacctattaccccaccctaatcatttagcaaaacccctacaataacacttaacagcagcactggagttttttgttgttgttgttttttgttttgcttgtttgcttgttttgagatggagtctccctttgttgcccaggctggagtgtggtggcgcaatctcagctcattgcaatttccgcctcctgggttcaagtgattctcctgcctcagcctcccaagtagctagggttataggcacacaccaccacacccagctaatttttgtatttttagtagagacagtgtttcaccatgttggccaggctggtcttgaactcctgacctcaggtgatccaccgacctcagcctcccaaactgctgggattacaggcacgaaccaccatgcctggccagcattgagttttttatctagattttatggagtctattctgggggaaaaatatgtaatgataagtctagcatgaataaatgcttgggaagatgagacaggtccagaggacaagatgtgaaaggtagtgagaggcccctggcattgggaaatggacactctggacagtgagtcatggataatagcaccctgtggatcccttagaaggcatatctcattcctggcccacacagcagcaaccagcctatgtggccaagatctttctttcactaattaacaaactaccagaaatacactaccccggctccacagggctaatttttggtctggggaaagaaggctgaggggcacaggtagaatggctcatactctctccctgggccctgctggactaaattgtgtctcctatgtcatttaaaacatcacagtaacccacggcctttaagagtcaacatgatggctgggcacagtggctcacgcctataatcccagcactttgggagacaaggcaggcagatcacctgagatcaggagttcaagaccagcctggccaacacggcaaaaccccgtctctactaaaaatacaaaaatgagccgggcatggtggcaggtgcctgtagtcccagctactccagaggctgaggcacgagaatcgcttgaacccaggaggtggaggttgcaatgagctgagatcgcaccattgcactccagcttgggccacagagcaagactctgtctcaaaaaaaaaaaaaaaagaaaagaaaagaaaaaagaaaaaacaaagagtcaacatgggaagtgaattcacattagtttattggctgttagttttctcacctagaaaatagtaacacaacttagccatcaggggtgttgtaagaacaaaatgggtcaatatgtgtctaatgccaagcaaagatttggcacatagtaggcccttggtaaataatttccaaaagaaatagtggtgtttgtctcatcattgatgacagaaactaggaatcatctatttgtccaacacattctcagaacatattaggaactcaattattcttatagaagcagaagacaaaaagagtaaaaagtgtagagaaggacataagaaggagaaagtgggagttggggtgagaatgaacagcattgtggggccccatttactcggcgaatgcctgaatcaccacagttgtttccgaagtccaggaggatgaaagcatgcaggtcaagccttcactaagccagatgcccatggagcagcagaggggtgtggggagttgccatggcaaccggacctggcagaaacttcacagtgggactcaaatcaaggtaacttcctaagagttcctggctcagggaggtgagcatagcatttagtaagtaagggttgtagacagccctgaggtggaaactatctctcccataatactcacaccctcccaaagcaggcttcttactgcactgctgttgtaagatgcagagacagaaaagggaacctccacttgctgagtgattactatgatccaggcactgtgcctagcacttatccttctttccatccatccattcatttacgaatccagccgatttttattgaacatcaagtcttttgaggcacactggtctgggcatggggaaaataatactaaacaaaacagcgaaagcccttgaagcttacatgttagtggcaaagaattatctcattgaatcctctcagctaagtgtctccatcatttccattttacagagagtagaagtgtagagcaattaaatgacttgtgtaaggatcacccaattttgtatgttacagagattggatgagaactagtcctgttccagcctttcccctgtatcactacaacttcccactttatcatggaataaggtcccaggataccctcatgtagaaagtgtggcctttggggtcaggcatatctatgttcaaatcctggcttacccacaaaatctctgtgtgacactagccaactgatccataagtctaataagaaaaaaatatttccatctgaaaaatgggaacagtggtcttttttcagagctgatgtgaggacagaataagatatcccatgtaattagcaaaaaaaaaaaaaaaaagagctaaataaattaaatgatagctgcagatcatattgcctgagtatttttttttttccagaaggctgaggtcacagttctccctgattcacatccccatttgcagttccttccccattacttgcaggggaataagctgtgctgtaggaatagcattccacccgggcatattgattgctgggactggagaaaattaataatctaattttccttccattttccctccctcttacacctcagctcctctcatggcagcagagaatggcataaaatgcattgcttaagaaattcgaccggaaataactcagtgttgttgatccacacattgcctataatttggggtttgattgattcttgctttggaaatgccaggttgagaggagaaaatgaaatttaagttaaatttggaattgaatcaatcacattttataatgaaaaaatagatctaaccccatcagacccttgtgtgtggaaaacttaaagctggtacactcccattgacttcctcctgagatccccaaagcatgagagaccaggtcctaggctgagaagtaatttatttcttagagtggcaaatggtgttgtggtgggggaaagggattctagaaactggagacattagggtgaagaagcccagcaggtagaaaggccacttaggatggggaaagaggctgggcttttgtatgtatgtatgtatgtatgtatgtacgtacgtacgtatgtatgtatgtatgtatgtatgtatgtatgtagtctcactctgtcacccaggctggagtgcagtggtgtgatcttggctcactgcaacctctgcctcccaggttcaagcaattctcctgtctcagcctcccaagtggctgggactataggcaaacgccaccacacctggctaatttttgtatttttagtagaggcagggtttcaccatgttggccaggctagtcttgaactcctgacctcaggtgatctgcctgcctcagcctcccaatgtgctaggattataggcatgagccaccgtgcccggactgagctttggttttagatgtggatatctaaatccaaagtcttccatttgatacctgcctaagttctggcaagtgatgtaagctctcagagcttcagttttcctaatctaaaaaagggtagtgataatccctaactgataaagaagctgtgtgttttaaataggagatcataattacagcactaagcaccatgtctgacatatacttagggctctgtaagctctcaatatatttccttccatctcatttcctttaaacctccctttctaatacttggcacctacatgggcatcagcaggatatgtgatactgttgctcatgctgaaatcctaactttcacacttagctgctggcccccgtggacaagtcatgtcacatctgagactcaatgcctttaattgggaattagttcatccaataaatagctatttaaggtgcaagtactgtatgccagacctcatattttatgctctcctatttccagtgcctatagcatgcctgaatatagtaggtgctcaataaacatctattgaatgaatgaatgagtgaatgcttaaatgttgtttccctttctaccaacagatgtcagtattggaatgctgctattggtatttttttctagcaaactgattcactcacttttcctggcaaggtttggttcctgcctggtcagaaatcatacaaaaacacccttgcagaggccgccaatctgcctgcatatcagggtgaccactgtagattgctgagtgcctcattaacctcactgagtgccccatgggattcccacagcacctgagctctggtgtctctgcttctctgccatatttctggaaactgaaattgggacacgtcatctgacaagtgcaagtgtcatactggaggcagaaagaaagaatattttaaactggggctttctcagaaactgtagggtatatggccccatatcctcagcgtgtctcttatatcaggggtttccatgcactgctttagtgtgatgtctcaatatgggacatattttcctttatcttgcacaccttggtccttgtctctccccatttctccctctctatctttgtcatgaactaatctcttgtgctgtctgactacggcactctcaaatctatggtatcctttaaatgatatgttatttccccaatatcttatcatctatagatttgtccttaataagatctaggcaagtgttcatccactcttattttcatacttccagagaaagaaaactcaacccctactaagcatcagttctattctcagatagtttaatgtctaaacagcctttgaatctcactctatgagtgaacttctgctgtccaaattaaataggatatatttaatatctccttcccagggcagctattttgttaaaggtggaaattaggttgccttgagctttctttcttcaaaccaaacactaataactttattttgtttctctaaagtcatattttgagtccttttattgtactttgtatagatttgttttgcttaagattactttcttagtaaaggatgccataataataattgttattattattatcatcatcatcactaccactatcactagtaacatagccactaacttaggtgccagacaatagaactaaatttttgcatgcagtatctcatctaatctttacagaaacttcatgatattgtttctactatcactcacatttttcgctatgaggaaactgaggccatcacttgccaaagaacatgcagcttaaaggtaatagggctgaaatgaaaaaccatttgatgtcagggtccaagctcttaaccatcatccttcacaatatctctatcaacctgctagatgtagcctgggcagagcagaagcaacaaatttaactgctgagctgctatccgactttagcttgccctgtggacctgtgatgactctaggtgaatttgtggtggcctcattgtcccacctgataccgaccacatgtcttcaagagaacctctccccatcacaaggacaaagtttaaaatgatggaagaaaatgagaagggctgtcgctcctcctttctcagccccagaaaatactatgggcctgaagcagctcactgtgctacttggagccaaatgattattgacaaagccactggggaacacctttggctagctctggtcctgggacaaagaccgtttctatagtgcaggcctagattgtggctgcctggtgaagttaaagccactggcagctgacatggaatggggctacaaacggctggctatttgaatttctctgtggcaactgcaggtagctgggcttgcaagtgcaaaggtcactacaaggtgttgacaatggtgttagagatgaagatgatagagatggtaccgtattattttagcttttattaggttacagattattctcaaatatctcattacctcttcaaaatcctatgtagttggcattgctgttatccccaatagacaaatgagaagtgacagtcttaaaggtgaactcatgttcaaacaacagaagaataatgggcctataagccatgtctcctgacacacagctgagtgatcttttcatgtcactatgttgctagtgtgcagcctaagtcccactagctggatatgaaaacagaaatagaatctgtgcgctctgattcttcatccattgctttttttttttttttttgagacggagtcttgctctgttgccctggctggagtggagtgcaatggtgcaatctcagcacactgcaacctctacctcccaggctcaagtgattctcctccctcagcctcctgagtagctgggattataggcatgcgccactgtgcacagttaatttttatatttttagtagaggcagagtttcaccatgttgcacaggatggttattgctcttataaatgtatccaaatgcctcaaagagctagtgtagtatttcccacaaaaccagatgtatcttgaaaagaaaatatttctatgttcacaaaattttgagacatgctatattctgcatgtccctcttaaagcacccaagtatatatctggtattaaaatccctaaaagtctttgcattacattctgtttaacaggattcagccgaatgtttccctaaagtattaagacattgcagaaccaccattctgtggaacaaggtacggaaaaaacgatctagtttaataatttatacaaaggttgtaaataatattagcagagcccaataatcaactggtgcccttatgccaggcactgtgttaaagattgtatgtacattatcctatttaaacttctcaactaccttgtaaggcaggggttacccttcatttacaaataggaaaaccagatttaactggtcactgggaagaggaagaggaaggttttcatggtcagtctggtctgaaaccaatgtctgtatccttcttcttcccaagtgttagaagaaaatagaattttaaagtcacagagaatacatgcaagaatgaaaaaggtaggcacaacagatcagttcaggaggctaaagactattcaacgtatatttagcaggctgacgaaatgcattagtggaaggaaaaagatgctgtactcaatagattaaattgcagtgtgtagatgagaaatagtagagaagataattcaaagatctaaagctctagaatggctcagaaataaatgagaaagaaggagaaaggaaaggtggtggggggtttctgattcataggtgactatcaatcgactggtgctgacttacccaaaatgttaatttttaagatactgttgtctgatacccatattagccctgttagtctacaggctgtttagatgcaccaccacattcagcccacaccaccgatgaattggagggtggcaaagaagagctaaggccaagcagtgagtgctgaggaacagagcaaaagagcagccacagtttccatggctaccaaggacgatcaggaccagtcacctcccatttccatgaaaggttcatttctagctcctttgaaagtccctgttccattatcttggaagatgtcagtggactttggcccacactttgtgaaaataggagcaggagaataacattgattgtgtatttagtatttactaggcctcctgtgatggcctagtaaatactgaatacacaaccaacgttattcccctactcctgcttcctcccctgctcccagcttccatgacaatgttcctttacctacagaacttcctttatcccaaaagcccaccgtaagcaccaggcaaagctgtccttacttgacattgggggaaatggaagatcaaagggtttaattgactagtaaggaacagagctagaatatgaacagagctagaatatgaaccgagacctattgatactcaaagttctttaaaagcttcctcagctgatcctgaccctgtgaatgtatggtgtctaatggtggtcacactgcttctaaaaatagggggcattttcacatctctgtgctccctcctcctcacctctttttcctgacagtgacactgtgtcatattcctaagaaacaatagaaatgaggcttttcctgatggcccacaaaccccctactgcagttagatttgcctgtctctttccttgtgacaggtcatatgcattcccctcccccatatgttgtcctttctacttttccaacatatctaagcagaccaactttcaagatcaaagagaactcccatctcatagaagtctgccttcaccattgcaactcacaagaacccattatttctcttaaccctatctcatatattttctgttctaatttgagccacaagacctcagaatggcaaggaactaaaagagatttaactacaacaagtcacacaatgcattgttgtgtgactgactccctctataatcattcagcctgcatttgagtgtcacctaaacttggagcttattaactaaaaaaaaaatgatgatgataaccctttctctttttttgagcacttactatgccggatacattgtgctaaatattttacagatattattttatttgattaatcataaaagcttgctagttcctagttttgcaaatcaaaaaaattgactctaactcagagttagaaagctattgagaggcaaaccaggattcaaatccagatctagatatcagagctcctaacagtattactatgtagtctctcttccctggtagcaatcagcataagaactacatcaatgccaaaagaaaatctattcctacaactataaccagctgaacatattcctgtcctcaagagttctaaaaactggcccccaccccttctctccaaggtacccctttggttctaaaaatggaaaatatgttgcccatcattcttttatttcaaagacagattctgtcatttgactctcacatgaggaaaatagacacagagccaggaaaaacggagctggaagaaccccttttgattagttggcctaatccaccatgctgaaggttaggaagagggcaggaggacagccacgttcacagtcagattgcccagagccagtcctgggttccatctaccccagcttccatgacaatgttcaccatttggggtagttgttgctgtttttgttgtttcctaccttaaccaatacctcctggaaaaaagaggtattggtataaaaataaaccatacccaaacattcccacaacatgaccttaataagctggtgcacagtagattatggcagaggaaagaaaattgactttagaattagagaaacttaggttcaaatctcagctctgtcatgctttggttgaccttcagtaagtcccattttcttcatctgtaaaatgggaataacatctactccacagcatcattagaaagattaaatagtggctgggcatggtggctcatgcctgtaatcccagcactttgggaggctgaggtgggcggatcatgaggtcaggagattgagaccgtcctggctaacgtggtgaaaccccgtctttactaaaaatacaaaaaattagccaggcgtggtggtgggcacctgtagtcccagcctctcaggagcctgaggcaggagaatggtgtgaacccaggaggcggagcttgcagtgagctatcacaccactgcactccagcctgggcgagagagagactccatcttaaaaaaaaaaaaaaaaagaaagaaagattaaataattaaatagcatgacatgcactgcatagcagaagctcagtgaatagtaaatttcatcgtcatcatcatcaacaaatttaagaccaatacatataaattctgttgtttgcactcaagagaccacttataaaaactcaggatgggtcagaaataggagacagaccatgtagactggaggatagtgagtttacagtaaggaaaggtccaaacacatgcagagcacctactatatgcgaagcctctgctgggtttttgcacctgttatttacattgtttctcatagcaacctttaggtcttcattttataaatcagaaaaccagctcagggaagagaagtgctttgctcaaggtcatacgcctagtaagctgtagagctggtcatgcgattcaaaactgtgtgatgttctaaacagaatatagacaggtggaccatgttccaaagagaataaccaggattggactggatatcatgccaggagaggacaccagatgaaggatttggggattttagctttgaagcaagaaaggctcagtcagagaggcctcttgatagggttgtcttcaaagacatccaaatatagaaagagaaaaaggaaacacatattctatatgagaagctattgtgaaccaagcctcaaaacctaggcacttgatgtgcactgtttcacttgctccttaaaacaatcctctgtgtaggtagtggattgtgcatggtgactcaagcctgcaatcccagtgctttgtgaggccgaggcaggaagattgttagaggtcaggagtttgagactagcctgggcaacatagcaagaccccatctctacataaaacttaaaaactagctggatgtggttgtgcatacctgcagtcccaggtactcaagaggctgaggtaggaagatcgcttgagcccaggagtttgaggctgcagtacgctatgatcgtgccactgtactccagcctgggtgatagagagagaccctgtctcttgaaaaaaaaactaatgatcttctgggggtaaatagcattatgctcattttagaaatgagaaaaatgaagcctggggagatcagacacttggttcaagttgcacaagccatcaggagcactggattcaagccaggtctgtttcaccccagcaacatcctggctcttctcagttctcactggagtttgttgaccatcaagggcccttgcaggtttaagcaactctaaggaggtctggcctaaggaagcgggacccaaggttcttgctcagcacccaaaccctcattctggtaaagaaaagaattggggccttgcaggccaaagaagactctgtcctttcctggatgtagaggttcagctgcaaaccacctggagattttattagaataaacacacccatctccagatccttaaatcaaggggtcttttgtttttattttttatttttgctttctgatctattgcctactcttcagaccactaacattttagcaaaaccatgtatgcattgtgtttaaatagtcatctggagataaatagctttgcctttagtgggggaatataagagaggataaaaaaagaaaaaaaaaaaacaaaagaggagaaaatgttctgtgaagcctttttgctcaaacacatttccacatggaaatctctacccatttcaggctgacactctggtctaaacctttcaagcctgctggtttaaatatgtcacttccaaaagaacaatggcagtcttagcccaagggccattctagacccactttctgtcttggtttttagtgtcaaggaagtgcctgaaggctgtgctaagaggactatctattctgggagtctgaagcccaaacttgaatataggctctgccattactcactgtgccacctggagcaaatcccttcccctggctggacttctgtcccctgttcatcataggaagaaatccattcattcaacaaatatatattaaggacccactctgctgtgagctagggatacagagctcagagccattaaatgtttcaatgtccagtgaggtagtgggccaataaacagaggtagcagagatcagtgcagagcagcaaatccttaatccagattcaggggtcatagaatgattaccaagagctgaagcttgtaatgtgtgtaagagttagctgatgggaaaaatggggaatgtgcagttcagcagaaggaaacagcagggcactgtacatagactggagtggtgggaatttcaggtacatgctgtgcagtgtgggcagaagaagccagagagataggcagggaacagctcataaaatgtcgtagttcattgcaaggaaagtggactttctcctagatcagtggtccccaacctttttggcaccagggatcagtttcatggaacacaatttttccatggactgcaggaggtgggggagtatgatttcagaatgaaactgttccacctcagatcaagtattagttagattgtcataaggagcacaacctagaccccttgcatgcacaggttacaatagggttggtgctcctatgagaatctaacgctgcagctgatctgaaaagaggcggagcttaggctgtattgctcacttgcccaccgctcaccttctgctatgtggccaggttcctaacaggctgctgaccagtaccagtctgcagcctgggggacccctgtcctagatgatatctccagtcctttcaggccagctctgccagcactgtgcaaacctgaaacacatcttcattcatttactttgacaacaaaaatgtaagtaagtacctaaaagtgccagacattgtgttgggtgctggggatatagcaggtacttcataatcccaaagcgtgaaccattaggtatatcaagatctgaagactgggccaggtgtagaggctcatgcctgtaatcccaacactttgggaggccgaggtgagaggaccacttgagcccaggaatttgagatcaacctgagcaacatagtaacacacatattttatttaacatgcagaatatatttagtctctatatttaaaaaacataaaaaaagatctgaagacctatgaaggatgagatctacaatatctacctccagaatggaggacaaagaaagaaatctcgttgagcaaaggcaatctataagaatatcagaggatatttacacgagaggaggctgaagaacatcctggctagaattagagaacatgaaacctggtgataaatcagtcttcgagtacatggacgtgaacgagcacatgtcacctgaaatgaaagaaggattagatttggagaaaaggaaagagggcaaggggactgagggaggtagtttccaaattgttcccaatggtctttgcttcctggtatccttgtccttgtgtaaaccctagtgacttgcatatatccaatgcaagaaggtaaatgttatgcaatgccacttccaaggttaggttatgaaagactgacttccatttagctcacactctctttggctctttttactttcttgctctggtgaagccaaatgccatgttgagagtggccctatggcccacatgagaagagctgaggatggcctctggctcacggctctcaaggaacaaaatcctgacaacaaccatgtaagtaagctgggaacagatccctccccagttgaagcttgaggtgattgcagctctggttgacaacttcactgcagtctccttcgaagccctgagctgggggactgatgatattgtgcctgatccctgccccacagaaactgttagataatgaatgtttgttgttttaaattccaatttgagggtgatttcttacacagcaatagataactactaccagtacctacttaaatggatagctgaaagaggctgatgagcctccattcctagcaggatatcagaaaccttcaagtttagaagagacttccattcatctagaaaacatttcccacacacatggtatgtgccagaccctgggcaactcatagaacttgcaaaagagccaggcacagctctgccttgaaggagccacagagagacaagtgagaaggtcaggtggagacatcataattacactgtgtcaggatacatgcttggctattttactgaagacttcacaagcttattaagagctgagagaaaagagccactgaagtttgcttaatgaaatccaggtcagcttcacacaggaggcagcaggcaagctgattccttgttatctttaccaaggcacctctccctggaagcccctatgttcacacatcaaccctggaagttggtgaaatgaaaggcttgtgagctctacaatcagacaaataaagtttgaaactcagctcaataatttcttaacactgtgaatttaggaagtcaataagaaggaacagctaagaacatgattagagtcgcacagggctaagagtaagcaacagagctatccattactagttgagaatgctgatacaaggaatcacgtctttcaaagcctcatatccccatatgtaaaacagaactaataaaatattgacttcacaagattacttaagttaaagcaagaagtttttaacatagtggatgataataagaaaggcttgataattatcagctctttttgttggaacagttacttaatttctttatgcatgtaaagccttttagtatattgcttaatatagagttctcagtgactgttagttgctatgattattaacagcagagaccatagacccagtgaattatcatggttcctcctagcctaagggctggccagcaatgatacatctaagttatatatccctgtgcatttataaaaatgcttcctaccccacccccagggactctcagctccttgcgctgaaatggaaggccacagattatttctgcagcaggagctgtgccaaggcatcattaaggtagagatgacagagacagggtagtggtggttccctaagtaactataactcaggtgctacacacacctggcgcttcctgcatatgctgttaaatttatgggacagcaataatagtaacaacattagcacaaatttatttgtaaaatgcccacacctgaacagcttgaagagctaaaatagaaaccctactaaattttatagaaatctatgtatatatgtgaagatgtgaagatgtgtgtaagtgtataagaattgagatcaggatgtagctgtgcttagagtagaagtaacagcagccctgggaatcataactatgattttcttcttccatttcgatcatcgactagaccagtattattagccatgttgctgccttcttggttttccagtagtcagcagctcgaggcaagaaaaagtgccattgcaaaagccagcaggattcaaattcccaaatttatcagtctctggttacacgaacttaggctggtcatttctgtttttgtagtatcaggttcctccaaagataaaataggcataactataacttagtcctactccatgtctagtgtggaagagaggcactccctcccacctctctttcttcataaagggcaaaacatatgaaagtatgttgtttttatagtctaatttcccagttgattatttgtaaagtttatttagcaaagtattataaccaggtagagagggatacagaacttgcccccctgccatgttactccacgttcctcaggggcatggacccttattattttctctaacaccaaacctggtattgagtatcagctaaattaatatttgataaaagaataaatggataaatgaatgaatggacagaggctttaaccaattccttatttgagaaaaagggaacaggcttcatgggatcatcctaaggcaggaaaataaaatccagtcattaccttctcagtgcagagaacaagatgggcaagagtttcagctgaagtattcccttgtttcacaataaaaataatgacagctaccatatttaagcacttactctgccctgagccctggattaagtcctttgcagggaatattatcatttcatatttacatcaaacctatggagttatagttactatgcccattttacagaggagaaacttaagttaatataaatgaaatttgtgtctgttatcacacaactaataaaattttaacccaagatatctgaccccaaggtatagcctctgaaactgtatctatactgcctcctaggtgactgcagagatgcatctttctgagcattggagacttccagatgtaacagaaattgagccagatactgctaggcacagggagctgaaacagaaacagacatggacgccatcctcatgaagtttccagtctggtggggatgggagatcagacatgaaaatgctagtgtacagaagaatagggggacatgagtgagtataccagaaagacctttttcagaaaggggcatttaagccctgtcctggtgggagaaaggatattccaatgtaaaatgcactgaaaaaggcagtgagtgacatgagatggggctggagaggtaagcaaaggcatgcaaaacgttgaaggccagttaatgagtttgatcttaattatgaaagagcagagaaatcagtgaaggtggcataatgaggcaacgtgttataatgcccggtctatctgctaagggagaagggtatcctgccagagtgatggtaaggaacaaggagtcatggcttgaatagtggtgacactggggatggagagagtcatcaaatgcagagtacagttggggatggaattgctggacttgtgatgaatcagatcttctaggaagtagaaaagggagaggataggtggtgtcttgacatctgtatccaaactttactcccagacagaatgtcttcaacaggtcatcttactgccatggggaagtacagataaaaacacagaataggccaggcgtggtggctcatgcctgtaatcccagcactttgggaggccaaggtgggcgaatcacgaggtcaggagttcgagagcagcctgaccaacatggtgaaaccccatctctactaaaaatacaaaaaattagctgggcatggtgatgcacgcctgtaatcccagctactaagtaggctgaggcaggataattgcttgaacctgggaggtggaggttgcagtgagccgagatcatgccactgcactccagcttgggtgacaaagagagattatgtttttttattattactattaaaaaaacaaacaaacaaaaaccccaccaccaccaccaacaaaaaaacacagactaacctagtaagataattttgtgtccttcttaattcagggctgaagacagtatttcccattcttcactccagttttgattagtcattatcattcaattgtttacttattctctaatcaacaaatacttataaagtttccatatttcctgtatgggccaaactgggcattggagatacagggaaagacaagaccgcaattcctaagtgatgcatcctggtttatctttgggatgggaacagtggtttcctagaactgactccagctggctcacaagatccaattgttaaatatttagggatgttgcatggcagttgttaaatgcagtggcttgaaattagacgtgataggtcaggcgtggtggctcatgcctgtaatcccagcactttgcgaggccaaggcgagcagatggcttgaggacagaagtttgagaccagcctggctaacatggtgaaaccccatctctactaaaaatacaaaaattagccaggcatggtggtgtgcacttgcagttccagctacctgggaggctgaggcacaagaattgcttgaacctgggaggtggagtttacagtgggccaagattgtgccactgcactccaacctgggcaaaagagcaagactctgtcaaaaaagaaaaaagaaagaaagaaagaaagaaagagagaaagaaagaaagaaagaaagaaagaaagaaagaaagaaagaaagaaagaaagaaagaaagaaagaaggaaaggaaggaaggaaggaagagagagagagaaagaaagaaagaaaggaaggaaggaaggaaggaaggaaggaatgaaagaaagaaagaaagaaagaaaggaaggaaggaaggaaggaaggaaagaaagaaagaaagaaaaagaaagaaagagggagggagggaaagaaggcaggaaggaaggaaggaaggaagggcgggccaggggcagtggctcacacctgtaatctcagcactttgggaggctgaggtgggcggatcacgaggtcaggagatcgagatcatcctggctaacatggtgaaaccccgtctccactaaaaatacaaaaaaaattagccgggtgtgatggcaggcacctgtagtcccagctactcgggaggctgaggcagaagaatagcatgaacccaggaggtggagcttgcagtgagccaagattgtgccactgcactccagactgggtgacagagcgagagtccgtcaaaaagaaagggaaaagaaaagaaaaaaaagaaagaaaaaataaagtagacacgatagaatttacactaggaaaattggcaaatactacaaatcaggttttttgttttgtttttcagagtcagtttaccagcataccactgggttggaatcatggggctgaaagcctaatggtttgtcttccaagttcaaggaaggcagaaatacaaacagaaagttaggtcacagttacaaactatacaccagtcttttatttatttatttatttatttatttatttatttatttatttattttaaagaatgccaagaattgcaggggcaggttgtagactttggagtcagacagatctgggtttgtatcctgtggccagcactcaatgatgatccaaattgggcaattcactttaccattcttatcctaatttttttgcctttgacatggagataatgtttacaaatcatgatgtaagtgctttgcacagtgcctattattaatgttgctctttttttcctccattttttttaatggaaagatatgccttcaaaaatctgctttgctgatgtgtagttcagttttattatatcaaacttttacataggctcatcaggaagaggactcctgtctgtttccaggtgctcttttagcacacagataatttagactcatctttaaacgtccagcttaagccctcaacacgtgggagggagtcaaatcctgaagttagtgggaggccataaatcgtgtataacaaatgcacaatatctttgttatacaagttattaatgtcagtctgggctgtggcctgtttacattctctgaacaaggagataaatcatcacccttgaactttcaatgggagactgaagagggagagaaggctctcaattcagttcttcaaagactttctaatcctcatacaaggagagaaggaggaagaaaaggggagagttggaaaaaaatcaagaaaggaagagaggagggaaggaaatacttggaaacctaccatatgccacatagtatagtcatttgttgcccacattattttgtttaaacctcattacaacactgtccatacttctacagatcaagataaggtgctcaaggaaactgagttacctgcccaaggccatatagctggtaagtggtggagctgggatctcacgcaaggtttgaatttgaaggatgggtcttctcctgtaccacacgatgaattatgtacaacgaggggcatgactttatttgaggggccaactccagcaggattggccctaaattgaggcagccaagtgggccggcctgccctcaacactgtaaccatggatttatcaaggtcagccacctcagccaaactacctgatccagtcaccattagaggatcttctcacctcacacaagaatagggccacaactatctctagacagccaccactcacaacacttaggacctaaaaaggagctttttcccccaatagccccttaaccttattgagcaagtgcaactttctgttgctccctggctcagaattccctatgagacatgttaaaaatacagtgctttgggccctgtgtaagacctactgaacaggaatctctgggagtggggtttagaaatctgatttttaaacattttttttcctggaaatgttaactattattcctgcagatggagaatcagagaaaggttttttaaaaaccacagtgataatccatgcattcaatacaatctgcaacaagcccttagccatgcccttgagtgcctatgggtgctgatgccttcagagcaatggtaatggtgtaagtgagtgtgtgtacacactcatgtatgtgtgcacttttctagcatactatatagaaatacagaagacatttctttaaaattaagtgtaaagcacatatttatgtctagtgaaaggaatactgttcatatttcttatatatagcaggttaattaggcttgtagataagactagaaacttattcataaccatatcaatacgcaggaagactaaggatacagaaaactttttaaggggctagccttggctccagactaccacttttactgttgccatacctccaccagagcagagattaggtagaatattgtgtgctagcctcggaagctaaccaacctgttgtattctcttacttcaagtgcattccagattaaggacaactttttctggaacagtcttggaatccaaccacattaatgtagattttcattatatacttactatgtcaggtatagttacagttaaaatatattccatggtaatatgttaactagagcaattcttagacacagtttataattttgtccttcataaggtacatttcttcagggtaaagaaccatttggggctcatctgaacacctggtgatatggtttgactctgtgtccccacccaaatctcacttgaactgtactcccataattcccatgtattacgggagggacccagtgggagataattgaatcacgggggtgatttctcccatgttgtcttcatgctagtgaataaatctcatgagatctgatggtttgataaggggaaacccatttcgcttggctctcattctctctcttgcctgctgcaatataagacgtgcctttcaccttccaccatgactgtgaggcctccccagccacatggaactgtaagtccaattaaaccctttttcctgtataaattaccaagtctagggtatatctttatcagcagtgtgaaaacagactaatacacctggttatctaggacagtattgcaatgcttttagtccactagaaggtaaatcaacttttgtgggctagcctgggaacactgcccttgagcatatgtttgcttttataagaaagcacagcctatatgccaaatggtcttacaaataaattgctagcaagccagtgggctcctaggttggggtcctaagggttgtagcaaaaccttactggggtgttgtgagccacaggaccacaagtgctagatgaaagcagagctagccgagagctataaatagtgtgccaagtgaccctaacaagctctcctatccactggggctgctccaacagctttctcttttggatacatgaaagcagctgaaagattgttttcccgagagctttttggctgccctgagcatgtcaagggactttgctgtttctaattatctccctttatgttctggccgagacttgttaatacaataaaccggtgtttccaggacgcgctcacaacgcagaaacatctcaaggtgttttacaagcagaagatcatgttaaatcaaatcaaataccaattaaagattaacagtggtgttagagagctgttatcacggtccagccagggccgctgggatggccagtgcttcctccaagctgctgcagtccagcttccagccagattgctattttggtatctactgggtgtcacagtctttgcctcagctccaggattccagaatatcaacactggaaaaatgttaaaggtcttcgcagatgatccctgttgtatcaaatggggaaactgggatttggagagaagggatgacccaacatcacccaatgttaagaatccaaacttctcaacatagaatgcctttggcagcaacgtaaatggaactggaggccattatcctaaatgaaataacgcagaaatagaaagtcaaatacttcctcttctcacttataagtgggagctaaacaatgtgtacccatggacatatagagtggaataatagacattggagactccaaaaagtaggagggtcggggggaagggatgagaaattacatgttgggtacaatgcacatgatccaggtgatgcatacactaaaagcttaagctttaccacaatctatccatgtcataaaactgtacatgtaacccctagatctatatacttaaaaaaaaaaatccaagatttttgagctactctcaagcacgcctagtcactggccccacctagatgctttcaactgctgtttctctgctgtctgcttgtggtgggttgaattgtggctattacaagacatgtctacctggaacctcagaattgaccttacatggaaaaaagggtctttgcagatgcatttaagttcaggatctctagatgagatcatactctgtttaggataggccctaaagccaatgattggtgtccttataagagaaaaacagaggaggatgtgaggaaaacagggattggagcaatgcacatacaggactaggaacttcgaggattgctgacagctccaggaggctaggaggaagccacggaacagaacagattctccctccgtgcttccagaagaaacccacactggaataccttgattttggaattctggcctcaaaaactgagagagaataactttctgttattttaagccaccaagttttggtaatttgttacagcagccacagaaaactaatatccccctcctggagtgcctttcctcacatcctgcacatggtgagaacttacctttttttcgagactcagtattagtatagcctccagcctgtgtggaagcactcttgactgaacccatgagctggatttgcacaaacctctttgatgttcttaagtgtgtatatctccatcaagttcatttcagcatctgtaactcattttttagttacctgtctctctcccctaccagaatttagagtttgcctggagtgtagaccatctgtgactcagttcagagtactagagccaatcatacatttggtccatacaggtgttgaggaaatgtctgttgaataaacatgagtataaacaagtgacctaatccttgtactcttacttctttgtcaattatagaacccacagccactgcatctctatgcctatctatcaacctttcctttcccctaacttgaagtctattaaagagactcaggttttcaggcccagatgtgaggtggtataatatcaaaaataaaagcaccagctttggggtcaaataggcatatgctctgattctgtcactttcttcgtaagtatcttaatgtctttgaacctcatctttaaaatgtaggtagaagattaaatgagataatgcatgtaatatggtcaattactcctctcagaagtaccatcactcccattttatcttttttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatacatgtccctacaaaggacatgaactcaacatttcttatggctgcatagtattccatggtgtatatgtgccacattttcttaatccagtctatcattgttggacatttgggttggttccaagtctttgctattgtgaataatgctgcaataaacatacgtgtgcatgtgtctttatactagcatgacttatagtcatttgggtatatacccagtaatgggatggctgggtcaaatggtatttctagttctagatccctgaggaattgccacactgacttccacaatggttgaactagtttacagtaccaccaacagtataaaagtgttcctatttctccacatcctctccagcacctgttgtttcctgactttttaatgattgccattctaactggtgtgagatggttttgatttgcatttctctgatagccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatgttgattcttcctactcatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagacagtggggttttctagatatacaatcatgtcgtctgcaaacagggacaatttgacttcctcttttcctaattgaagaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttcgcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtcgaaaattctcttttttggttgtgcctctgcctggctttggtatcagaatgatgctggcctcataaaatgcgttagggaggattccctctttttctattgattggaatagtttcagaaggaatggtaccagttcctccttgtacctctggtagaattcggctgtgaatccatctggtcctggactctttttggttggtaaagtattgattattgccacaatttcagctcctgttattggtctattcagagattcaacttcttcctggtttagtcttgggagagtgtatgtgtcgaggaatttatccatttcttctagattttctagtttatttgcgtacaggtgtttgtagtattctctgatggtagtttgtatttctgtgggatcggtggtgatatcccctttatcatttcttattgtgtctatttgattcttctctctttttttctttattagtcttgctagcggtctatcaattttgttgatcctttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcactcaggagcaggttgttcagtttccatgtagttgagcggctttgagtgagattcttaatcctgagttctagtttgattgccctgtggtctgagagatagtttgttataatttctgttcttttacatttgctgaggagagctttacttccaagtatgtgatcaattttggaataggtgtggtgtggtgctgaaaaaaatgtatattctgttgatttggggtggagagttctgtagatgtctattaggtccgcttggtgcagagatgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagaatttagtccatttacacttaaagttaatattgttatgtgtgagtttgatcctgtcattatgatgttagctggtgattttgctcgttagttgatgcagtttcttcctagtctcgatggtctttacattttggcatgattttgcagcggctggtaccggttgttcctttccgtgtttagtgcttccttcaggagctcttttagggcaggtctggtggtgacaaaatctctcagcatttgcttgtctgtaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgatggcctgccttgctagattggggaagttctcctggataatatcctgcagagtgttttccaacttggttccattctccccatcactttcaggtacaccaatgagacgtagatttggtcttttcacatagtcccatatttcttggaggctttgctcatttctttttattcttttttctctaaacttcccttctcacttcatttcattcatttcatcttccattgctgacaccctttcttccagttgatcgcatcggctcctgaggcttctgcattcttcacgtagctctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggagctgcgttcctttggaggaggagaggcgctctgatttttagagcttccagtttttctgttctgtttttttccccatctttgtggttttatctacttttggtgtttgatgatggtgatgtacagatgggtttttggtgtggatgtcctttctgtttgttagttttccttctaatagacaggaccctcagctgcaggtctgttggaataccctgccgtgtgaggtgtcagtgtgcccctgctggggggtgcctcccagttaggctgctcgggggtcaggggtcagggacccacttgaagaggcagtctgcgggttctcagatctccagctgcgtgctgggagaaccactgctcccttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcatggtgcgccgtttcttaagccggtctgaaaagcgcaatactcgggtgggagtgacccgattttccaggtgcgtccgtcacccctttctttgactcggaaagggaactccctgaccccttgcgcttcccaggtgaggcaatgcctagccctgcttcggctcgcgcaccgtgcgcgcacccactggcctgcgcccactgtctggcactccctagtgagatgaacccggtacctcagatggaaatgcagaaatcacccgtcttctgagtcagtcacgctgggagctgagaccggagctgttcctattcggccatcttggctcctcccccactcccattttacagattaagacattgaatccaattgcacaggtagtaagtcacattgcaggacttgaaattcatacacttcaagtccatgctcttaaacactacattatgcagaattatggggcctcctacaagataccccctagtccgtttgctgagtaataaattattctatcgtttccaagaatgaagcctctttggaatagcacacatccttgaatttatcttgtttggtattccagctccttgggaggcctctaaattcatatctaatacagacttctctagtctcagctggtttgagacactgtggatcgtaatgctgagagtatgaaaacaaatgccttctgcccaaaccatcatctttcaattacaaatcactctgtcaatttgcaagtgttttggatgcgaacatcttgcagtctggcactagttagagctgagaagaaattgagagaggatacatggggagaggaagagatgaaaagaagaatgaatcaaggatagaggaaggagaaagacaatggaatcgtcaatttgaacagatgtttagaactcatctaagtcagggccctttgtagcatagttccaggggccctgatctcatggatctatgaattggaatccaaggagtggaatggtggctcctggagttgtgaaatatcatgacacaaagtccaactttatttatttatttatttttttagcagtgggtgaaactaaggtatatagaatttaagtggctcctctaacaagtgtcagcaaagtaatggcagaactaaaacctttgacttctaattcagtgctctgtagcatacaaagggttaggtatccaaacataaaagaaaacatggaggtatggacaaagagtgatttgcaggtaaggcaaaagagttaagacttcaaagaggaaaaacaagacgaagaaggaatagagatgaagagagatcaagaagatatctacaaaagagaaaaggagggatggagaacaaaaagacaggggcagagaatctgtaaaaaacagagaaagtcaaagatgatatagtgcagcacaaattcaaacaaaatgaaagagaaagactgccgaaataaaaatgcagggttagataactggttagtcgctctccgatgaaaatatctaatgcaccccccttgctggtatgcatgaggtcctggcctcttaatgagtccccaggcttcctatgaccaggcctggctgacctcccccacaactcattccgctcagcttcctgcctctaggggtgtcttctgcagggactgtcctgcttctccactccactcctggatattgcttggttcattccacctaatcctttgcaatatcatctatttcagggaatcttcccatcccctcttcctactgtccaccctccagtccaggcagggttgtgagaccctcttctggatcccacaacagcccacaaactcccattatattatttatcacaatggacggctaatctctgttttaatgttaccatttttctcccaacagactgtagatttcctagggccaggaattaggttggattcatcttgtatctccagcaattactgcagggtgaaaaatatactgttacactcaatgcatgactgatgaatgaatgaagggacaaaccactccttctctcaggagtgacaaattatgtcgacaaccactggggggtgctcttgggtaactccagcaatgggcctgggggagcaggcggtggaatttctctgttacaaacacctcagcaaagcagagaaggcaaaagtgataccaaactggagagatccttctagacttcaccaggtgaggctgagaatggaacaaagcctgccctagtggatgaaagaataaaatgaaagtcagagaaaatggactcgagtctatggaactggttagctctgtggtctgggggagtcactcatcactgaagggcagcagttcacttgattcacacaagcccaggcgatggccattattatccccggccctcacctgccgggaatagaaggatgaatgagcaagacagcgttctgttctattgaggaaaaaaaaaaagaccttaatagtacaggaatggggttatctgggattcttattctaattgccaacatttattgcatattttctatgtcaaacatgattccgagcactagcaatgcaggtctgagcaagtcactgccccatgttgcccgttctctagaggaggaggaggaggaggaatagagacgtgcaagactaaccacaattttaagaaaggaacgagggtttgatgacaaaagagatataggtaacatgccaccacagtgacatttggtctgagggatcagggaaagcttcagaaaggtggtaacatttttcccaaccagacctgctgggacatttaggttttattagacagagctgagtcaacatgatactctaggctgatggaacagcccagcatatactagcaggcgaagatgtgcagggtgtgtttgtggaagtgtgagcagaagatggaatggaagtaaaggctagagaggtggatttggctaatattaacagcaggcaggatgcgctgtcagaacagcagaagtggcaatcgttggggtggaagtggctgcagctacagggaccacagtagcagctgctttgatggtgcagggtgccaagaactatactaagggctgtgtatacaatacctctttcaatcctaactatctacgtatctatctatatattatgtaaatacacatacatatgtatatgcatgcatgtgtatatttatgtatatgcataggaatgtctattttatcaacatgtagtttttatttccatttcctaagtgaagaccatgagacacagaggggttaaataacatatccaaggtgagtaagcagcgaagtcatgatctacaccgaggtctgtaaatttccagaggcaatgcttttaaatgctatactacacctcacccactgtcaggctaagaagttgagaatttatcatgtaggccaagagggagacaccaaaggtatctaagggaataacacaatctaacaaatgttttcagaagatgactctagggccactcctgccccaacatccttgggcgatccctgccctcctatttttaatggagccccttctggggcaagaaggggtggacatggtccatttgtagcagtccccaaatctcccaaaggagtccaggatgagcccagcccctctgacaaatgctccagcctcccctagccccagggagtgatttatcagcacagcgtcagcgcctctgcccagcagcctgtgatccaaggctggcggcccaggctggggtttttaattagctgagagagggaagagtcaagccctctcagatggaaagaaagagacacaccaagaaggctcatgaatcctgaaccaaggacccatcgactagagtctggcagtggtgggcagatggaggggaagggggagggggaggaggaggagggggcaggctgattgtctttttggcaatttcatggtctcccttgttttctggtccagacactacagggagaatgggaattcagactacctttcacacaggaaaccctggagtacacccttttctagtgtgactttgtgaccagaagtcagagagcctaatatttagctccatctttgccactgaccttctatataatttgaggtaaaaattacaacttaaaagctttcaggctttggagttagacacaagcttaattctcttttccatgctgtttactaaaactgtgactcagtcaagttgcttttcctctctgtgcctcagttttctcatccatcaagtcaggacaagatctcatattgtaagggctaaatgagacagcacaggtaaattacctgtattaagaagagaggttcctccagtctcctgaagagaccttcagcaggcatcccaccatttaactccagggtcatttcagatcacaagaatcatactgaaagcctgctccataggccctggggatacagagctgagtgaagtagtctctgcccttgcaggcttcacagtctggttggaacagacaatgagatgggcagttacagagaatatgagagagagctgtgattgggggtagtagtgaattccatgctggcataaaggaagggcacctgctgagcttcgtggacacctggtaagcacgctggagtggggaatagctgaactgatttttaaagaacaagatgtcactgttgagggtgaaaaggcaagagaagattatcccagacagaggggactgcgtgattagaataagatggagcagaatgcctggcacactgtaggtcttcaaaataatttctgtcgaataaaggaaggaaagaaggaaggagaaaaagagggggggatagaagaagggagggattcatctcattgaaagtttgaggggcagagagttgagatgacactggctaagtgatttgaactttattataatgacaaggagaaaccatcagaaggtttcaacaaaaaagtgatgttttcagacgtgtgtggtagaaaggtcacttttggaagttgggatgaagaggacaagagtggggtgaaggagaccagttaggaggctgttacaataattcaggtgaaaatgacaccaacttgtctaaggcaggggcagcgggggtggagggagagagcatctcctttaatacaggatgtagtcacagaccacacctacctacctgcctcatgtggtccagccccatcaccatgacaacagcctctttaacatccctggccataaagagataacaactcttacatctgttcctggaggtcctgcctctatatttttttcctttctttttcttcttttttcccctttgattgtatctgatccagccttactgggtaattgagtgtttgagagtgaaaaattatctcagcagcttggcccttatcttgacagtgaagcagcacttttaatttaattttgttcagagacgcatgggtaacaaatttcactaatcgcccggctgttgccctctgcatggtaacgagccgtttgttaccaggcagcccagcataaatacatgtgggagagcaggcaggggagagagacagaggttgggaggaaacaagggacagacacaatcaatatgaaccaggcttgggctctgccatcaggtggagaaacagagatggaaggccaactgcattagcacagagaggagttttggcgcgagactcaatggagctcctgtccttgttctgtctcctatctgggtgaagttctgagcaagtgatttaaactttccatattttagggttcttatctgtgaggtgaggtggggatgttcacaatctctacttctctgggttgttgtaagagttaaatgaggagctataaagtaagtaagctataaggtaagtaagctataaagtaagtaaggagctggccgggtgcggtagctcatgcttgtaatcccagcactttgggaggctgaggcgggtaaatcacttaagcccaggagttcaagaccagcctgggcaacatggtgaaagcccatctctacttaaaatacaaaaattaggaagccatggtggcaagcacctgtaattccagctacttgggaggctgaggcaagagaatcgcttgaacctggcagatggaggctgcagtgagctaagatagtgccactgcactccagcctgggtgacagagcaagactctgtctaaataacaacaacaacaacaaaacaaaaacagtatccctaaaaacaatgtcatgatattcttgaggctgctaaggaccttaaaggaaaaaaaaccctggcccttcatccaatgtttggatttctttcagaacatcctccacaggttattgttcaaattttgcttgcattcatctaatgatggggaactcactgtggaagcagacaagaactctgacactcagaattgtcttgcttatgctgacctgtaatatgcacccttcaagtcccagcctatgttagcacagccctgccttcttgacttctgtaaagagtcaatgcgcaccctccttcccaggtgagctcctcccttagacttgtatatagaaataatattgtttctcaccacacccaagtcttcttgtatccagctaaaaatatcctgtagagcatcagagctagaatagcctttataagtcatgtaacacaacattccactttatatattaggaaactgaggtccaaaaagaggaagaaaattttaaaaaataagttgttattttttgagtgcccattatgttttctccctgtttccagttttccaccattatttcgtcaggcatctgtctctatatttttatccattgaagagccatccttgatttatggtcttttgtatcccaaagccattactccaaagcacctcagccatggacatatgactcacactgcattatcttactttggttaaaaaataaaaacaaaaataccatgttattagaagcaccgaattggagaatcaggaaagacattacagaattgtagtttatttaaccagagaagaaccgaggccacagaatttaattgatctgatattctctattatttattataccctctatagcttgaaaatggctggagggcagagaccactagtcttaaccatctatgccttggttccttaaggcaatgattctcaactatggctgttcctggagagctttttattttatttttatttttattttttgagatggagtctcactctgctcctcagtctgtagtgcagtggcacgactttggctcactgcaacctccacctcccaggttcaagtgattctcctgcctcggcctcccaagtagctgggattacaggtatgggccaccatgccctgctaatttttgtatttttagtagagagggggtttcaccatattgggcaggctggtcttgaactcctgacctcaggcgatctgcctgcctcggcctcccaaagtgctgagattacaggcttgagccactgcacccggccatcaactatggttgctcctgaagagcttttaaaaagatggtcgggtgcagtgaatcacacctgtaatcccagtacattgagaggccatggcaggaggttcacttgagtccaggagtttgagaccagcctgggcaacatagtaagatcctgcctctacaaataattaaaaaattagccacgtgtggtggtgcgtgactgtggtcctagcttcttggggggctggggaaggaggattgcctgaggctgggaggtcaagtctggtgtgagctgcgatggcaccactgcactccaacctgagtgacagaatgagaccctgtcgagagagagtgagagagagacaggcagaccgaccgaccaaccagcatgcccagtctccacctaaacctattaaatcaaactctggactgaggtccaaagttaggtatttattatttaaacctaagtgtgtttaccatgcagatagggttgggaaccatgatacaaggggaaagagccctttactcacaacatcatgcttcatggacagagaaaaaggtcaggaaccttctcatggtctagaacccttttcaactggatatttacttttgatttttctttctctttcttctttgtttttcacaattaagtaaaagtgagatatattcattcctccagggattccaagaccagatacatgatggcttgaataaataataaaagggatgaacactgtttttcaagatttcaggtcaatctaattgtatcatagacaattgagagcagctgccctagttatagaaacacagtctcctcctgtataagttaaagtagtcagatctaaggctacaattgttcatcacttaccatcttctccaggacctgtgctaagtttgttgcttttattatttcattacaatcttgaaaccactcatagaagaaagagctacaagaatggccattacacagctgagaaaatcgtgggttggttagagtgacttaccaaggttcacaccgcgaggacacataactatgtgtgtctggctccaaagaccacaaattaaacactgcacattaaactacctccagcaaatccacccacctcaaatccctttcaggaacaggcagagtataaataataaacagaagggtaaatacatgcataatatataacattgtgattcacctacatatttcttttttaaatgagttgatttgtttgtccttaaaagtaattattgtggtttgtaaattctgccctccttcaaaaactcatgcttcattcacacttatctggctgtataatattctctcaagtggatgcatcatcatttacttagccatcctcctattgttggacatttgggctcattctaatttttcagtattagagattatgctacaatgactatgtttaggtttagcacttcaagaaaaatgtacagtgtcacagaaaaaatatggtaatataatgccgagtgaaaaaaaacaggagtgcaaatgtgtgaagattatggttgcaaggataagaaagagtgtgcaggaaatggggatggggaaaaaatgaaatgagctctcgaaggttttcatttatttctatttttctatgtccctttagtagaattattacattattttacattggttgaagaaaaggtaaaaacaatgagcataccaccaccaataaggttgaaacagctcaggtccacagatatccttagagcagagagatgagcttaggaatcagtggtcttgacttcttccacagacagaagcctaggaaggagcttcctaagggctggagtcatgtcttgctaacccctgacaccccagagaaccacactgttcctagaatctacaatgtgtattaaatgaataaaagcataaaatttcagagctttaagaggcctctgatgcaatttcttcaaacatcacacccaaatgtaatggatagagagccaaggggactttcccaaagctctccagcattttagctcctgaaccagagtagaggccactttttctaaagtctactccaattagaaaaggcatatggcaaatttgcccaatgggagctgtggaagaaaaatccttcgccagtgaaacacagaatgggtttgactgagtgacttggggtactgcacattgttatgcatgctgaatgccttgcattgttagttacaaatctcccctgaatccacttgtcctgcagtctctcagctgttctcatgacaaatgcccctgggctgtggcatctgttttcttcacgtggagcactagttttatttgcaccaaagatgttgagggaaggacatgttctacccagaatccataaataagaaacataccctcagccccttcactttccagtctacaccctctcctacaacagtttcctactgtcatgcctttatttacctccaggtaggaggcagaattttaaaatagcctccaacattcccaccccctgcacactgtctgtatactccccttaatgtgggtgccactgtgactatgataggatatcactccataattagattacattatatgacaagggtgaaaggatttttcaaatgtactaaaggtctcaaataagttgacaatgagtttatcagaaagaagttcatcttgggtaggcctggctgaatcaagtgagcccttaaaagagaatcgggccttgaaggaggggagtcaaagtgtgatgatctcctgctggccttgaataaacatgttgtgaaccgcctacaggggagacatgtggcaagggcttcagagcggcctctaaaatctgagaacggtccctgctgacagctggcaggaaaacaggcacatcactcatacagctacaaggaaatgaattctgccaacaaccacataagcttggaagaggattctacatgtcagctgcaatggcagtccactgaccccttgacttcagcctcttacatgatcttgagtaaagaacccagttatgccatgactggactttcacctacaaaactgggagttaataaatgcatgttctttgaagctgctatgtttctgtcaactggttactcatagaaactaatacacgaccacagagtgctgacatccacactctcccctcaactagaacactcctgagctcagatctggttggcaaatgtccccatctggatggctcacaggcacctcaaaggcagcagctccaaaatccaactagtctctttctctcctgaacacttacccttccttccttgcctggctgtgtgattctcccagtccctatgctggaaaccaatgctcactttcagcaatcttcagtggctcaccttcttggagtcagtcagtcattgggttcctctaactgtatttttaacatgttcctgtatctaaaccttcccatgctcacccagagtgttcccattctaccccaataacctcctaactagtctccctaccttcagtctcactctcttccagttctttctcttctgtagaaagtgtgatcttcctaaaacagaaatgaaataatagatcccttccttcaacagtaaatgccttcctggccgaggcaggcagatcacctgaggtcaggaattcaagaccagcctggccaacatggtgaaaccccatccctactaaaaacacaaaaaattagctgggcatggtggcacatgcctgtggttccagctactcgggaggctgaggcacgagaatcacttgaacctgagaggcagaggttgcagtgagctgagattgtgccactgcactctatcctgggtgacagagtgagactctctcaaaaaacaaaacaaagcaaacaaaaaacacccttcatagactcgtcatttcatggaggttcaagtgcaggctctttcctgctcacacagacatgccattttttagagcttggccacctctcgtccatatttcaggtataagctataatattggcttcttaaaggtatagttcatgagtctcctgattacattagttcctcttttcttttcatcagaggcagtcctcacagtttggaataatatatttattcatgtgtctatttgtgaaatacactctcccttccctttttcctctggcatgactagaaatttcataaggaaatccatcctattggtctatttcccaccatattcctggtcttcagcaaagagtctcagtggaattagatattcagtaaacattagttgattatgcaaataaaaaaaaatgaatgaacttggcattcaaagcgtttctcaatctggctaaatttatccttcccagactttttctcactgtcttccttcacataccttatattttaataacgcatgacactatttaaccatcacaaaaaccctgtgagataggattatcatttccaattttgagaggaggaaatccaggcctgggaatgtacatttacttgcccaaaatctcccaaactgacagtcaggattaaataaggttatgcatgcaagcatctcacacagctggtgacatacagagggtgcccatgaccagtggcatggtctgtttatctggaaaagagtttttcaggggtaagagaacactggccgtctcacagcgttgggaagaaaggggatgacagagtattcttgcttggggcgggaagcaaagagtcacagtctctcattctaaggaaaggcgggtgggggaatcctgctgagcctagttgaaaaacaagaaagcaagagagactgattattccttctcgctagtgtaagcaactaaaatgacatgtttgctttatcgcctttggtctcccatttgattcctgacagccatctccctcccttcgatggcgggctgtcaggtgctgagctggctggcattgcacaggaagaggagtacagagaacaatttaaacaatatttcagggaccatcatgggctggaggagggagtttttatagttagctggctttctttctgcattcaaggaaccctcatttgccaagactgcttgacgtttctgtgggtttgggtagaagtagtccagaagggatctttaagaaaaaaaaaaaaaaaagccaatgtctattttctttgaggtttgaaggaagggagagaatagagacagataggagctttttaagcccataacaatttctgaatacataattttctcttctctaatgtctcgttaaatagggccaaatgcagatgtagatcaaagctaggtttctgtattttactgcattttactgtgcttgcaagtaaagggaatccaaactcccagtttctctgtccgtgagagaaactagaatctctccagaaagcctgtataaactaccagaaccttctggaggaaggagtccactcccacaaaccacaaacagctgaacatttgagcaagagttacggtaagcaaaaatgagcaaaaacctacaaagttctcttaggggacagttctgggggattgtgaccatgaacagtctttggagccaaccgaaacccaattcaagccacagctacgcaacttattggttccattatcttgaagaagctactctgtttagtttcagttttgttcttttaaatagacacaaggacaacaattgattgctaggaagattaatgaatgtgcaatagacctgatacaaaagtgacacttaatacatagttgctataagtagttattccccttataatggttatctaagttccaggcttgggaaatggggggatacactccataggggcccaaagccaggatgggaattggaatgtgttgttggctgatatatcaaggaagcttgagagtggtggttctcgatgctggctaatattaaatgattagaatctgaaaaggatttcatacttatatccagacttttggccagacagtcctatgaaatgggttgattcttggaattggcattttaaaaagtgattctgagatttatttaggctaaagaactacccagccctgacagctcttcttcccacacagcctaggacacctgccttgatctaggtcctagaactcacgattctctcaagtaggaagcaccagagtgcccagcctcctatgcaggccctaaatattcagcttctccagctgaccttgttgtcttctgtttctgaaaaggaatcctcttccttgggccttggatgttgtagtttgctttgtgcctgccctccatgccccccacaacccttcatcatctagtgcatcatcctcggggaagattctggattgcttagactatttctagaaaatggtctttgaatcctagcctgtggctaagttcttacttcttactgacagttctccccagtggtgtgctggtaattgtttaacaatgggctctcccagcaagagcaagcagctcttttaaaatattttaagtattttccagtttccatagtttgaatctttctcctatggctgattacaagctcccaatgtggcatcactcacagcagagttgggaagagatgagtacaataggctctcgataaactgggatgggctggtccctgcacagcactggaagtcatccttgtcatacgttttcctacctgaccaaataccaggccccctttgttggtggtgccctgggacggctggtcctacggatgctgccttttgtcctccatactgaactaacttttcagtgcctgagctggttctgaccacgactatttctggtcccagcccctcccaggctacctttccccaacatctcaggggttacagagctgataccaggaagttctcagggatatgatcaggtttgctgtatcagacacagacatgggtatcctcttcctgtctctttttgagtatataccttgtgtcaggcactgttgtatgcactttacatgatttatctcattcatccttataatggcctgaccagattttgaaatcaaatagcttaaatacaaattcaagcttcccttaactcatggcagcctcaggaaagtgaaccctctcaattcttagtttcttcatctgtaaaatggagagaagaataatcccttctcctggtattgtttagaataatatgaaatcatgcatttagacaggacagaacagcatagagataattcaataaaactaatacagtttcttctgttcttttcctctatctcccttcttgttgaacccatttctattatggaccctagaatggttttattgtgaactcagagagggtcatattctaccttgctggtctacagataggaaactgaggcccaaagccttgctcaaagcctcttaaccaaacaagagacacctaggattaaaactcaagtcttggccgggtgcggtggctcacgcctgtaatcccagcactttgggaagccgaggcaggcggatcacaaggtcatgaaatcgagaccatcctggctaacatggtgaaaccccatctctactaaaaatacaaaaaattagccaaacatggtggcacgtgcctgtagtcccagctacttgggaggctgaggcaggagaatcgcttgaacacaggaggtggaggttgcagtgagctgagatcgtaccattgcactccagcttgggcaacaagagcaaaactccatctcaaaaacaaacaaacaaaaacaaaacacccaagtcttaggacttccagtgatttcatgacatcctcttgcttggctcttcctcctcctgtccctcacccagcgctttctcccctggctttccaccctgtcttcacttctcccggctttccctgtacccatgtccaggccctgtaataaccagataaacccaccccatgaaggcgctgatgcattcacctgtgggtcctctagctaaccctttttcttgagcctctagtcatgtcttcagtgggaatccctgcagggtagggagtagcaggctgatctgccccatatcttggacaccatttcctctccttaaagcctagccctctctcccatgttactctggctacaatgacttagaggctgatagaatactgcttgatctgtcttcagtgtttactctgttctgagtagcaggtcctgggggcgttctctgcaggttggcaaagggcagccagtagatctgcccatgagcaaggctacctaaatttaggcaagaagcagaggatggtgacgtgaaaagctgcatcacaatatccccaaggggctaggcctacaaaattcacattttcaagaaaaatgtttattgtttttttcttttcctttttcatttttttctttttgtttgtttgtttgtttgtttgtttgttttttgagacagggtctcactctgatgcccagtctttagtgcagaggtgcaatcatggctcactgcagccttgacctccagagctcaagcaatcctccagcctcagcctcctgagtagctgaaattaaaggcacatgccactacatctggctaatttttttgtagagatggggtttcgccatgttgcccaggctggtccggaactcccaggcttaagtaatccacccaccctggcctcccaaagtaccgagattacaggagtgagccactgcgcctggtcactattgtttttctagaaggcagattaattttcaagctggtacattagaaagaggacctggagcctgtgtggctcaggcactgatgtgctgtaactggctagcaatgaaacaattgcatggtggatgcactcggctaagcatttcctctgcttatgttatctcatttaatcctcataacaagcccaaaggagaacagaaggacaactgctacacttatcctcctttacccaagagaaactgaggtcagagaacaaatgtgtcttgccttaggttctgcaatgctaggaaatggcagagcaaagatctgaacccatgtctactgattccagtgcttatgtacaacctagaagccccattattttctgggtatattactggaaataatttcaacctgacaaagttgcaaagataagaagagtacaaagaatgcctatctatctttggcctagcttcacctgttgttaacattttgccccatttgatttgtcatttgaggagatgacatttttaaccttgaggaaaatgtttcccttctctgagccttggtttttatgtgcataaaatggaagactgaatggattacctttagagtgaaacggaaccttgttgcttgatgagaagtgatggataaaggatgaggtaagcccttggtcagtggtcaaggcacagttgctgcctctttctccggcctcattttccatcattcctgcacatgaatttgggctctactcagttctggcatctctcctccacccccttccccagtgtaccacgtaccatccgccctcacaccttggcaggtactcttccacagatgctcagctttcacttcatcccattttcatttcctggagtctctgatccattttgggactcatggcttatatttcataacaggaggcttcagttcccaaaggcctcctctgcagatatgacttgaacttttcctcacctatccttttcctcgaaaacaggattaaactgtgtgtgttggaggtgggaggagaatcataaagaaaagccatacatccacataccttagtacgaagttttgcttatggattcagtggttcttagttacagaaaatcccagcttaggaattgccaaattaaaacaagcaacaaaaacaaagaaataagacaaccagtagcattcatgctctggttctctctgctggagaactaagcagcaaagcttagaggaaagtacctgagattggggatcagaaaacctggatttctataactggctgagcaacctgcagatgagaaaagcgaggtccagagagggagacagatgcacccaaacccatacagcacagagctgggctgggaggttcatgctgggtgcctgcactgctgaaatgatccagcagctataacagctccgtctcctgctcagcattgtgcccagggctgggcaaaccacctgcacttctcatctggactttcagctgtacagaagcttatcctgattagcaacgcttccctgtgtgagtttgcacactccttgcctccggagactgtaaccactgtgaggttcggtgctgaggctccattttctcactgcccagcagcatggttattagggttgcttattccacacatacaggctaaactacaacggggctcagtcttgatgacatatgatgtaaatatccttgtatgacaataagaaagttgaggtcccgagggagcacaggcttgccaaggtcactaagctagttaatggtgaggtgtggacttgagcacacatctcctgactctgagtccaacattctttgctctatggagtactatctccgatgaatatatgttaaattcttcccactagtaacctactacattagctagtttattacttaattctgtaaaatgccatcagaattggcacacttaaaacaatgatatactggagggttatttacttgatcaaacatagaatgccttgcatgacaaatagactcttttatttattttttgtgtttttttccccattctttattattttttttcataggttattggggtacaggtggtatttggttacatgaataagttctttagtggtgatttctgagattttggttcacccatcacctgagcagtatacactgtaccctatttgtagtcttttatccctcgcccccctcccacccttccccccaagtccccaaagtccattgtattcttcttatgcctttgcgtcaccatagtttagctcccacatatcagtgagaacatatgatgtttggttttccattcctgagatacttcacttaaaataatagtctccaatctcatccaggttgtggcaaatgccgttaattcattcctttttatggtcaagtagtattccatcatgtatatatacgacagtttctttatccatttattgattgatgggcaacaaatagacttagacagaatgatcatatatgatatggggttagacttattttcacagagcatggtgaatttgtacacatgcttcctggaccagacatacaggtgagggtaacatatcaatggtttaaggcaggagtcagctaagtttcatgggtgaaatctgaactagcacctgtttttaaaaataatgtttattagaaaatatttatgtccattcatctatgtgttgcctatggcaggtttcacacagtctaacaacaaagttgagtaggtccaacagggactggaaggcctgcaaagctgaaaatgtttattagttggccacttacagaaaaatgttgctggccccttatttaggaaatcccaccagacacgcatatcttggtctctccacctctttttctccatccctttgcctttttctccttccttccactctccatattgatggctacagttctgtgctttgggaagaagttctacctggaaataccagacacccctccaaaatagtcccattctccttacaaagagccaaaatcttaggaaagacaaagtacttccaaactatatgtcaaatctctttcataatggatcctattgctgaaaatgggatttgagctgatttagtttggagctcagaatgttttgaagggaaagaaaatattagaagacagaacaaatatttcttgggcatctttgggtaagacccagcaccttccactgggtgcttactctgtgaggcaggtgtcaacagctccattttatgcaaagggaagcacccacaggttaaaatccacccagggccacatggaagggatgacaaggtgaggtcaggactcacagccaggtctggctgaatctaatgccagtcctatttctctcatgggatatgctaagagagagatctatgtacaaacacttgttagagatttcctctctccttctcctccatgccccactcccaccactagccctcagtgtaaccttttctgccatgcagccttctggcctggttacatcgttcccagatggcacacaggacagtcacactcaaagaacccaggcagagtgtgcttttcaccaccaaggccctcttgccactgctgggcatggccttcctggtggccttgcagtagaaaaatagggagaggtaaggccccagctctgcttaccaggagcaggaaaaagaagggaagaggagagcaggccctttcccagcaggcaggcataaagcgagacaaaacaagaggtggcagacagaaaatcagcctccatcctgaacacctataagccaaacactgtgcaggtgtttctttcaaacattcactcatcattcattcattcattcaaaatattcacccagtgcctactatgagcccatccccctgtgcttgatgttgaggacaaaactggacacaaatgacaatgtgtctatgctcgtgaagtttccagttcagtggaggacacaaatagtactcagggagcatatcagtaagtgtaaaattatagtggtgaccaagtctacaaaggggggtacagcacagcatctggtatagaatgagacagggaaattaactcaggtatggacagctttgcagaaaatatgccatttaagtggaggtctcacgtgatgggggggcaggtgaatgagtcaaacggcagggaagagcattccaggagacaaatgttgtgaaggctgtggcaggacagatgcaggagtgctggggaagaggccccgggggagaggtggagtggggagggaaggagcggacagagccctggggagagagtcagggcaagatcactcaggattgcaggtgtgtagggagtttccatttcatcctgaaaacaaaaggaaagcattgaaagcttctaagaggagaaacaacatgatccctacttacatttgtaaagatgatcactctggctacatgattgagaatggactggaagacagcaagggagacttagcaagagaggacttttagcagttttaaagcaaaggatgcaggtggcagggactaggatggcagcagtagagaaggggagaacttgttggcagaagttgaagttataaaggagatactcattattttaatcttcacaatgaccctgtgaaggagatgtagtgactgcattttaaagatgggaatttgagaatactggttcatgtcccatggatgaaaaggggcagagccatgtctgagactcaggcaacttcccagcctcaactctttcaggaagccctcccacatttagctgctgtttattgtgtctttcttctcccaaagctgggataatctgaaacgctcagttcaataactttgtcttccaaaatcttctaacatctgaaacagtctgaactgcagtgcagggcccttaaccagtgctgatctagttgcttctgagcactcctcttaaatctctacttagagattgaaaaagtgagactcagagaccagcagggacttggccaaggtcacacagaaacgtggtggcaaagccaggactgaaaatcactgttcctgtcacacacagatagccccaaagactcaacttccttctgagtacttcaaagatggtaaagttgaatgtctttatcaaagcccacatgcctcgagatttggaaaacacagctcagctcctatttttcagatagacctgaaatggttacagtgaattcatatggagtcccaaatgctattagatgaccattctcaactagcacagggaactgcctttcctggtacttttatctctttcttcccctacctccttgaacttcatcatctcttctgtgtcaccgctgggctggctcacacacccctgggcagactgcagggaactgctgagtcattgcctttgctaaagaggagctgaaatggtgatggcagaggaataggagaggactgggatgttacaggtccaggcaggcctgggggtgtagggaagaaagaacccatcagcccagccaaaggggacaacagaaccattctagtgtcacagttagaccctaaaggagagaaacaggaaaggggagtggcactggacatgggggaggtaaacagggtgcaaaggaacctgaagctggaagccaggtatatcccaataacaggagattctcagaaatatgccccatgtcccattcacacacaagtaagaagagatctcagagaagatccacccgtccactctcccatgtttcagattgaaaaacagagatctggataacaaaagagactttactaaggtcacacagtgagttggtagcagatctgagactcccttcctgtccccatagtaaatccaatggtccttctcagcaacttcactctgccacaatttctctccctccctatctccacctaaatgccttgcaggtttcaagtaattttaatctttagaacaactctctatgctttcatcttaatatcctcattttacaacttagggaattgatgcacagagacgttaagttccatgattaatatgacattgccagtaagtgggggggctgggatttgaacccacgtaacccaccaccagaatccatgcttttagtactatgctctgttgctcttatatcaccaagggctcctggacctcccttggctcacctctgtcctgtgcctttttcccattaagtcagtgaatgctgaaggcaccctaactcctgcccaaactatatgaaacagaaaaaaacagatcacagccctttcatgaagaattgcgggacttgcagactgagacattgggttctaagttcatttgcctagaacaaagatgttgcagaaccaaattcactctctgtattcaacaacaaaaaattatagcagctgcggcagcaacaacaacaacctaacaacatcaaacacagtattaagaaagctctccctgtgatcctgcaaaaagcgtagggtaattcatgctcactgaatctaagcattcaattccttccatattctctcagttcccttccttgttgtctccttttcttttagcatttatcaccatctaatagatttgtattttgatataatacaaaccccacaagagcaggaattttaaattgttgtttggtttgtgtccccactgcctagaagagtggcaggcatgtagttggtgcagaacaaatatttgtggtatgtatcaaaggaagaaagaaaggagggagagagggagggagggagggactaagggagggagggagggagaaagggaggaagggaggaagggagggagggaggagaggagaggagaggagaggagaggagaggaaaggaaagagggaagaagggagggagagagggagacagggaggaaagaatgaagggatggaaggagagagaaagaaaggagttgctgggttaaatcattcatctcgaggcctgtagcttgcttttgcttttctaagttgaactccaatttataggggacatgctcagtgatgaatgtttttccaattatctataaatagcccaggcctgctgaggggacccattgacttccccagccctaattctgactgctggattgtgtgagggagaagaccagtcaagaatcatcaatcgtcaacttctaaatctccaatgcaggttcccggaagctgaggattgcttctcagttttctggctaagatcaagtggagaaagctgaggagcaggaaggagggagaggcagatcccatttttccaatggctacagaggctgcaaacccttcccatgtaatgtgtcaatggaaacactcctcccacgtggggcttttcagggaaagatgccagaggtgaggagataggaaaaacaacagtgagaactgaactgacattaataatgtctgacttattttgcttttagcatacaccagacaccataaattttttacatagcttaaccaaaattcatccacaaccccatgaggcagttacaaggtacagcttgtagatgaaaaactgaggcttacagaaggcaaataacttgcctaagagccaaaggagcacacagaagttatggggatctgtgcttttgcagtgtccactgtgcatggatagaatgcatgcagcatggtttgtgagaaaagttcctcctcctccttctccctaccccagctacttctcagcacacctctttgtggaggtaggagagaaggaccagtttccctgccacatgacctggacttgtcacaggaccttcttttcagtgggtgggtaaagcccatggatggatctgccctttatcactggcatggaatccatgtttgtaccccaggagagtctcttccaagaatccagtctcaaactggctgctttcccatccttatagacaatccaagatgaagaatcacattcacaggcaattgcctgaaatatgctgttttcctttcagagcacgttgaatcatcagggaacgatggatcttggccacaggttttagacctttgtggagtcctgcttcagcatttggccatccccctacattgagtgccattgtgagaaataattatccaatactgaattttatctgttgaagaaactgcctagaaaggcacacggtatcttatttatacataccaagttgaggactttacctctggtctggtaagtaaaatttcctgaacaaatgcttgattctttcccattaaccctgtacattttatttctgagtatgtttcccttcacactttggctgccgggaatttcttacttaaattgccagcctcttctaagaactacaaaacagtatggcagggattattctgcatcaacccaacctgggtttgaataattttccttattcttattttcatattaatatgattagttatttcatttcctcttttgaagttttaaaaatctgcataaaccaaaaacaattcacagtattttttgaagaataaggtgggacagaaagcaaataaagaataagccaggaaaagcattatactgaaggtcacccatatagccagggcaacagatactaagctcagttttaaccagatggggaccaggttagagaagatttaggatttgctagtgaacacaaaatctgatttccaggatttccttctacaaactctggttctggaaccttccaaggacactattacctttgctgcggcggcgactgcggtactgctccgtgtagaatgtcagctgagtttcatcgtctgcctctgagcccgacgtccccttggctctcccaaagctgattcctcctgtgagtaagcacagtctatcagttagtctcccaggcctccagaagtttgtgagattcctcaaccatcccagagatcagcaatcccatccccagacttttctctgtaaatcccaagcaacccaggagtcagtgtgataaatggaaggagttcatgctctgcagtgaagcagatcttgggtccaagcatgactcagcagcttctgagctgtgtgaccttgaagagaaaacacacctttctgagccctgggttctgtctctctaaaatagggataaaattattcaccttgtgagattgccttgaagattaaaggagatgtaatatataaaatacctggtccgcagtacatcctaaacaactgatagctattgttgcttttggtgataagcaaacactctagaaaacactctagacaacttaattttaaccacatttcaataaagtgcaagacgctggagatacaaagataaataggactcagtctttgccaggcacgggatcataagctagtcagcaggacaaatggaatcctaaggaagcttaaacctaattcatggcttctgtttaccactcaatgaggtgctaggaatatgggggagtgcaattcatttcaacacggagggcctgagaaggttttatgcaggagcgaagatttaagtcaggtcttgaaggatggatgggcctgcactgatagaaaaaggacttccagcagaggtaccagcttgagcaccctcaggaatgggccatgtgggcagtcaggggcaacattaagtggagaaatgactgggaagacacacagcgggaggccttgggtgccaaacggaggatagggagctttacttttggtttcatggaaggttctggagcaagagtatgaattggccagccatggtatatacaaggaagaacactccagtggtacctaggctgcaggatgggtgccaggcagggtaagcagccaggaggctcagtgaccacctaggtgaatggaggtcagggcttgcatgagggcctgtgcagcgaggatgggaggaggagatgagtgcaaagggtgcttcagagacaaactcagaggagtgtggagggaaaagggtaatgcattcatatgctgtgaacagctgattgtagaaaggataaaaaagaaggctaaaagcaattatgccacaatactaatagccattaattccaaagagagaaatatgggtatgttttattgttatctttgtgctttctgcttttttaattgcctaaaggattagtaaattatttactctagagaagaaataaccaggagagagagcctctgaggatgttgggggtgagtagatgggcacgggagaataaggactttggtatttaaaattgtttcattgatggggcttcagacatctacagcaatagactttctgggaggagacttaagaatctggtaaaaatggttgtcctggatggagaattaagtgcctgaaagatgggaacagagggaggctacttttctctataaactctttgcatcttttcaatcaagcaccatgcaaacctattacctattcaaaaatttcaactaaggaaaagaaaaacatacattaaagggaaatgttattcaatgcacgaaaggatttattatgtaatttcctcaggtagggtatttgaaatggcattcagtatacagaaattctacttgcagacactttttctgcaatatggttattacacattcattctttctagcaacattgttgcacaatctgctatgtacctagaagatttgtagacattattgctgacaatcctcatcatgatatactcataagagtggtgtaattaacaaactagataataaagcaaagatgcaaagacatgcttagacatgcaaagttacttgcatagtcacacagcagatgactaggagagttaagcttcgaggctagtctgtccaactccaaatttggtctctctgtaatatacacattgctttccttaaaaccactcatgagcgaaccctgaaagagcagatcatccttcgagtgtcaagatgctaagtacagcattcagagctttgtatacaacatctcattccgaattcatactacccttaggagagaggcatcattgtgcctactttacagatgaggcaagtgatgctcagaaaagaaaaatgatttgctaataatgagtgaaggtggacttcgaaaccaggtggaactaatgcccaagctcaaatttctagccacttatgatgctgcctctcagtttaaggctctgtaaaattgaaagattaatatctgcctccccacacccatccttccttaagacggtatgttctaatgagtgggaaagtacaaaggatgacaacatttgatctttgtcccaaaatgtgtcatcaggcaaggtctgtcccggagccttagtgcacacttccccaatccccagcaactaaaagcagggcctggagacatcaggagacttcagatttcagattctgccagatgcagttctccatttaaaggcttagctttgaagtggaattggcagggacctcatggagattttggaagtgactggagagcagaggtccccagaagccagtagggcttttaaaattgccattaaaatattttactgttaaaaaaaaaaaaaagaagaagaaagaacaaagaaaagaagggagaagggctgggcatgatggctcacacctgtaatcccagcactttgggaggccaaggcgggcagattgcctgagttcaggagttcgagaccagcctgggcaacacggtgaaaccccgtctctactaaaatacaaaaaattagccgggtgtggcagcatgtacgtgtaatcccagctacttggaggctgaggcaggagaattgcttgaacccaggaggtggaggttgcagtgagccgagatcaagccactacactccagcctgggtgacagagcgagactccgtctccaaaaaaaaaaaaaaaaggagggaggaagacttttgttcatctatacataattcttggccaaagaaaaaatgaaggcatctgataaagtcattctcttatgttcagaaaacatctgccatactctctgctatgtctggagccacagagcaaaaaggagggtctatccctgttaggaggccacccaagactcttcccacagccccttggatgccatagccacactttgaaacatttcagcaaaattctcactcccttccttccttccaatctccactttatcttccctcccatcctaaacacatgacctgttatggccctaccatggtgaacaaatctggcttacaggaatcagactttattctttccctactggagcaagatagacagagtgacagaaaagtcaccaggaaattctaatgtaagaaaagcgaacacttgcatagtgcagtatctcttccaggcactattctaaagcctttacatgggttgactcatttcatatttacaagaaccctaggagataggttactacatttattcccatttcagttggtgagaaaatgaaggcacgtagaaattaaatattttgtccagggtcacagcttgtaagtagcagaaccacgattcaaattcagacagtggcgggtaaatctattccttttttacaatgctggtttataataaaatatgaacaaatactttgtttaatatccacagccatccctataaggactgtatcatgagttttggtttcatagatgaataactgtctcagagaggtgatacgaggtagtaagtgggagaaatgggattgaaatttggtctgtctacctgcaaagcttgcttcgtacctaatacaaccagggaaagtgtgtgtgtctgtgcctatgtgtgcacacacacatgcatgcatatggatgtagagggctggcaaatgcttgatatgttgaccactaaggattagcagttctcttaattgactccaacacctggacctgttttcttgtaggaactctaatcaggcttagcaagatctttgtgactctcccatctttccacatgtccaggcacagtgaccacacccctataactaccataagggtttccataaaggctttcccttctggtcaagcctccatttccaaactcttctgacctttattcccttcttgtaagtactaaagtaccatgtgttcagagtgaaaactgaggctcagaaacaatgtctataaaccagattcaatagaaatataatgcaaaccacatatgccattttaaatgtttcagtagccccattaaaagggtaaacataaaagttcaaatgaatttccagaatatgttgcatttcactcagtatattaaaatattatcatgttaacatgaaattaacataaagttattaccgaagtattttatatatttttcataagtcttcaaaacccagtatgcattttgtgcttacagcacatcacaatacagacaagccacatttcaggtgctcaccatattggagaacacagttctagacatatttgtacaacaaatattactgagcaaattaagggcaaggatctgagtacaagatgaagatgaataagccacgacctccactaaaatgttcaatcttaaaaaacaatttggatttttgacctggatgaaaaaatggcacagctgggattctgttaaacaacagtatctatggtccctactctcaaggcacttggagtctagttagtttctatatttgtttatccatgagccaagggaagtaatggacttcagtagaaataaattaagttattggagtcagacatgagttctagttctttgattcacttattagcatatggccttggacagggcatttgatctctctgatctcatctttaaaaggggtacaagaactcagctcaatggttattattgggaaaagagtatgctgcatgtaaacattctgcacaaagaccaagaagtgagagtcagggcacattcctcaattacttgatgcttgtctgtgtttaacagaatgaaagggaggaagtgctgctggtttgaggtgccccctgactctcctgcctgctgtgacatcctggggaggtggcagccacccaaggcatacagcctctgagtatccatataatctgaaggggccacaggccaattacagtctgacttggaggtgattcagatggctagaaaagggccccctctgttagcattttaatataaaattggtgatttagtgcaataaaatgcagccattagttacacagggctgctcccgtacttccatttaggggctgagagaaagtgagaatggttagagactggcaagaaaaaagaagaggtaatctatctgctggaaccagcagcctttctatccttgctgcttgggcccttggttcttctggtaccacagagcctgaggtggagccattaagaaggtgagctaaacacatgccacggtgtgataagtactgccccaggtaccttacatgcaatatccctcctacacctcacaaggggtctgagatgtaggagttaatcccattttattggtggacaaataaatattcagaatctcactgttgcttaatcaaaattacacaaatggcagagcccaaatttgaatctgatgtatgtctgattcaaaaatgctctgttctcataaaaacatgcttactgtcattagtcaatagaaaatgcaaaccgaaaccatagatatcacatcatacccactaggtgggtgataatcaaaataatggaaaatagcagatgttggtgaggttgtggagacgttggaaccctcatacattgctgctggatatgcaaaatggtgcagccattgtgaaaaccactttggtggttccttaagaagttaaacacagaattaccacatgatgcaggatttccactcctaggtatatacctccagccccaaaactgaagatagggcattcaaacaagtatctgtacatgaatgttcatagcagcactatttacaagtcaaagggtacaaacgacccaaatgtcaatcacctgatgaatggatgaacaaaatgtggtatatagacatagaatattattcagccataaaaaggaatactgatacatgctacaatgtggatgaatgttgcaaatattttgctaagtgaaagaagccagacattaaaggcaacatagtatattcatattctatttatatgaaatatccaggatagctaaatccgtagagatggaagtagactagtggtggctagggctggacagaggaaaatgggaatgaggggtaacagttaataactattgagtttcttttaggggtggtagaaatgtcttggaactggacagaggtgatggctgtacaaccttgtgaatgtactaaatgccactgaattatacactttaaaatgatttattattattattattgagacagagtttcactcttgttacccaggctggggtacagtggcatgatctcagctcacttcaacctctgcctcctgggttcaagcgattctcctgccttagcttcctgagtagctgggattacaggtgtgcatcaccatgcccagctaattttgtatttttaatagagacggggattcaccgtgttggccaggctggtcttgaactcctgaccttagatgatctgcctgccttggcctcccaaagtgctgggattacaggcgtgagtaaccgtgcctggccaattaatgattaattttatcttatgtgaattatatctcacaaaacgaaaaaaagaaaccaactttttttttttgtaatatcactaaattagtgatagaaccataaatggggaatgtgagagctgtgagagagacagggagagggaaagttggggcacagagtggaagaattacatagccaccttgaaagaatcaagagctcagacctctggagtcctagcccagtgtgtggggatgcagaaggtgaccattcagtttgtcctagaccacatgttcacctaaaatcatcacaatactcactcatttgtttatgcattctttaaacaatcatttactcagggcccatgctgtcccaaacactgtctaggtactgaagataaagcctcaataaaacagacaaaaattactgatttattggagtttgctttctagtaggaaagcattttagatattcttggcataccattctagggcttagcaaagccttctacatgagaattcttacctcaattttgctgctaaataaatgaagatattcagagatatttaaagccttcccctagatggcatagatatttggtggtaaactaggaatttgaccccaggtgtgctctggggctaatcagggcatctgaacaacatgaaagtcatgttatggaaaagtatggagcaagatgatacaaggtctttcctgggcctatgagagttaactcactgctcttcttttgcaatctaccttctattcttgggctgccctgtccacagacctgctctgccagcctcgacaggcccagccctccacactccatctcctgctcttgctatcatgatggatggtggtgacatgttaaattattcaggctccgtgtcttcctcaagctggtgacagtgatattgcatttttagattacccagaactgtgccagataaagaaatatgtggttcaggaatggaaaaacccatctgacccccaaccatctagggaatacaaatggtcccagtcatagaaaaaggacagaagtgggtaaacttcccacaccccctataccacacaactcacaattgctctgagctctagagctaaaccacaaatgttcatacacattcacttctcggagatgttttgaccacaactgctacctgccatcaggcacctgctataggccaggcactttacacagaggttactatgctattcctccaaatgtggccaggagaggtggagctccttacttgtggtcacccatccagctaagtggaaggatatggattcaaaccctggtttgtctgatcccccagggaagaaatttctgcggcattcttgggattcatgctgaatttttaaaatggatttttatggtgaaaacctatatatgataaaatatagctaaacctgattgtttataatttcagggaaagaataagaaataactgagaggtccatttacagaagactgatgaaaaaatcatagcatatagtctttcataagaccattgaaaacagtgacatagatctaaattatagacatacaaacctctccatgacatacttttgggtaaaaaaatatgcagagaagaatacaaagagggactccacttgtgtaaatttatatatgcttgctcatatttggtatgaatgccattctgtgtatgtaataaaaataaagaagaaaaaagtaaaaagtcattctgagatggcatgatctacggttatgaacaaagttttaagaagcatataataaaacatattttaaaaacaacagtattctgtttttaaagtgcacacataaaatatatgtaaatacacacatgcaaaaacatattgaaggaaacatattaaggtgttacggtggtttttctctggatgataagatttaggtgtgctttaaaacatttcttattgttgctcctacgcatttaaaaattctcctccaatgaacttctaatgcttgctaataaacaaagatacctaataaaagctttgcttatttttttaataagtactctttattgctgcagtttaaacccattactcacttgacctttaacgtaatatggccatctcagagggggatcattccatcacccaagaaaggaaatgacccaatttatccctgaattttggcttaaataactacttacgagggagaagctcaccaatctagcttaactcactcttccagggaagtaacgctttgtcttcttgaacatcccactcctccctgtgggatggtatattttccaaatggggccataacaaaatctcccatcctgccttatcttttgcaatgagaccttcgccacacccccatcaaaggcagagtctcatttccctgcccccaaatctaggctggccttaggaacgtaactctaatctacagaatgcagaggaagtgactctgcaggatttctagagatagaacctgaaaagcaataaagcttttgtctggctttctaaaaacactggttctctagatgtttcctcttaggaaaactgccacggtgctgtgagattcttagccacatagaaaggctatgtgtaagtggttgagtcaagagtctcagctaagcccagcatttaagacatcccaccccatcccaggtggcaaaaacatgagagaaccttctagttgattctaccctctgccatctgttacccgtggatgttttgagttttccaagctgaagtccagtccttgtggaactgagataattcacctttcctttatcattatgactccctgactcctggaatccgtgagtataagattgttggtttaatgcactagctttgggatgttatatcatgcaaccataggtaaacagaacactccccttttccagtcctacaaaaatctccacactctttccaagttatcaccatatggcagcctgggcaatgggaagatgagctggtgtggtgtccagagaccctggtcctaggtctgtcctgttcctgacatacggtgtgactgaaaaatatattatcatctcacagatattgcataacagataatacttttactctcttcccaaacacagcagctcatttgacattcacaataactggatgatgggcattgctattcccacttgaaagatgaggacacagagggtcagagacactacagatgccttggtcaaggtcccatagctcataaatggcagagcagagaggagaatatagaaccaattctggaagctacagtagagtaagggggcagatttgagtatctgaggttggtcaggtattaagttccgtgaaatttccactttctagattccgtccagacttttgaaatggtagagtcagactgttagcttccctttatgatggtcctcagtcatctgaggttgcttatgtgcccactcacaatcttttcatccaagctacatatttcttttcttcttttttttttcttttgagacagaatctcattctgtaacccaggctggagtgcagtagcgcaatctcggctcactgcaacctccgcctcccattttcaagctattcttgtgcgtcagccccttgagtagctgtgatttttgtatttttaatagagacgggattttgccgtgttggccagggtagtctcaaactcctggcctcaagtgatatccacccccctcagcctcccaaagtgctgggattataaacgtgagccactgcacccagcccaagctacatatttttattaattccttcagccattccttatatgtttaaaaattataatttttgaattataaagtcagtacatatttattgtagaaatgttttcaaaaataagaaaggcacaaagaagaaaataataatcaagtcaaattttattactcccaactgacttctcttactttgagattttaacagtgcatttatatgcatacgtttttacaactaggtttcattgtcttgttacttgagcatatcctgtgaattttgtaaaaaatatctatctatctatctatctgtctatctatctatctatctatataccgatacatttatttatgctaggaatacatattggggttaaattatatacctgacagctttttctattatgtaatttacatatgtcatatgtgtgtctgtgcatgtgcacacatctagatttatatgtacaaaatattcatctatacatgtatctatacctacatatacccaaatgatactggtgattttctctgaatattgagatattcttcttatcttttttcctttttgtgagaaaataaatatagattgcttatggaattaaagctaattaaaatgtcataaatattatcattccattaagtattcatcttcaatatcacctaatgcctgaaaagttctactattgacatagtagaattactatgtcaatgtactgcttatttaaccaatttcttattgtttaaattttacattgtttccagtttttcactattttatcacacattcttacaggtaaatatttctacacatccctatgcatccccatgtagaaatttcttgagtgttgaaagagaaattgatgggtcaaagggtttcgacatagttaaggttttttgatctatattgtcaagacaccctcccgaaaggatataccaattttatcccaatcagctgtatatgagtgactatttcactgtatcttctgtaacactgggtattacatcattgttttcaaatcttagtaattttgatatgcatcccatatttcaaattcattctgccgtatcctttttaaaatagttcaattttctcacattctttttgcgttttgatgtccagaattgggcatgctaattcaggtgtgatctgacccgcatagagcaataatggactacacctccctctctctgaacacaagacttataataatgcagcccaagcctgcttcagctttattggcagctgacttacactcaacatgccctcagttccttgttgacatgcactgcaaataaatctggtctttcctatcatgtatttgtagaattgatgcttctaaaccaaagtaaagaacgttttgtactaccaaattgtatctgtatatttcaaccctttcttctagtctctcaagatgtacttttttggtcctaatcttctgatctcatagttgcagtattccctgactacaggccctttatgagttgaataaacctgaaaaggagcaggaggtaagaaagggaacaatagtgactgactgcctgctacatgtcaagcaacaggactaaacatttatgtatggtacaatcattgagtacatgtaagactgcaattaagttgatgctgatatccatgtgttaaatatcaataaattgatatcttcagggattgtcttgagaaagattgcacagccagtacagagacggggttggttgggaagtttaactgtggcccttgttattcccagtattccatgctaggtattcccttctttaagacactgacattcatgttggaataaaacttgacagctaatgggcagagaaccctcttcagggtgacatcagactgtgaatgaaaactctttgagaacatgtaattgaataaaagtaaaccatcttgactatactatcaagcagcctacaattgtgccctttggaaaaaaacaaaacaaaacaaaacacacacacacacacacacacacacacacacattttgttcattcaatctgttgggagcccataatgtgcctagaagtggacatgcactgggaagtgaaacagaaatagtttctgccatcagagagcttacatttaattgggaagattgaatattcaaataaacacatgcagaaattaatatacttgtgagaaccagagagttctcactagggaaaacctagcatggaatcctgggaatagaaagacacttaacttcccagcaaactccatctccaaactggctgtgtgaccttgctttgtcaaatatcttgggtgcattcagatatctggtatctgtggtatatccctgatcttcccatgcaacaaaccaacccaaatagaaatgcaatacatctggcataatttttcttcatgaacccatgatggcttctggtgctcccaacttcccttcacatattgaccatgtaaatttgacaaacccacctcattgtacttgagaatcataatcaagattcaatagtgcttcaccatttattagtaagctggataaaatctgtccttccggctgggcatggtgactcacggctgtaatcctagcagtttgggaggccgaggtgggcggatcacttgaggccaggagtttgcagcctggctaacatagtgaaacccccgtctctactaaaaatacaaaaattagctgggcgtggagatacatgcctgtaattccagctactcaagaggctgaggcaggaaaatcgcttgaacctgggaggcagaggttgcagtgagccgagatcttgccactgcactccagcctgggcgacagagggagactctgtctcaaaaaattaattaataaataaataaacaaacacagagggagaccctgtctcaaaaaataaataaataaataaataaaaataaataaataaaaataaatctgtccttcaatagaattttggaaactcttgttcctgccttgatttctccaagattacacccaactctctggttctgaaaacatctcaagattattttagcccctggaagtaatttgattgggtctagagatggaaatcaaggcagccacttcaaagtaaatacttaatacttctgtgttagaattccccttcttataaaatatctttattctccctttcttagttttcaggtttttttcttgatgtgtgacaaatctgacagaatcagaatgaacttagttctttactttcatctggtaataaagtttcagttgtttcatccaataggacaactattttcttattcttattgttccaaaagcaattttaaaagtttgttttacctttgcttattttctttcaaatttgtccaccatgcattgacaattttgaagcctcagcctttccgggagtattctcatgagtttgggctaaattgtttcacctttttggccttttctgtcatcttttagtttcctatacaagtatatcttctccctctatgcttcccaatttccctgctctttttaattgtctgtgattatttgttcagaattttatttttcagaatcttctctgaaatacgcctatttcacgttggaatctgctgccatagaaccaggaagatctatcctctgccattaaaatgttatgtatatatatgttcataaatttttggttataatttttcatcttttgaaataaaaaagttatttcttgctttaataatatccagtgctgtctggatattattttatgaaatgatcattttcctaaattgctgcaagcagtgcaaatttatacggtccttttgggaagcaatttggcaatataaaaaagaaccttaaaaaatgcccatccattttgacctgcttctgggaattcaccataagggacccatcctagacacaggatgggctttatgcactgttatactcattgcaacattatttataaatattggaaaatggaaaatcgccttaatatccaacttgaggggaatggttaatgatgttagaatattaggctttgatgatgatgataaaataatgtagaaaatacttacatttcaatacaagttttaagaaaggggataaaaacacaaatcctatgttaacaaaatgattaatatcaaatacagaggaggttctgcatatggtacagaggagtacgctagtaacagacctatccttgtgcagataataatgatacattctggacaaaatgccaaaaatactacctgagggctcctggaagtaaataaaagcagacatattttggaaagaagttgaaaagtagaggaagtagccagcacaggatgaatttctcatcttcaaggttcttcctttgagggtagtctacacttacagcatagctcagggaacctgaagcagcaggagtaagtttgccattgtctggactgaggacccagtggatggatcccagatcaagtaaagccagcagagagtgagggaagaatcaagaaaaggagagactcagagaaggggagcccacaatctgtgtataatctctgcccatatctccggctgacctctggactacacatgtgaaaggcaggccctgacaggctcagctgaagataataaaacacggagatttgagctgctgctcaccaaaggcaggacagctgaagtccaaccaaattaactgccttcaaaaacaaaacatgagcattaaagaaaaataacaaaacccaagagtcttcataaaataaattcacaattcccaaagttaaatccaaaattactcaacatatggtaaaccaggcaagtttcattcattcccaagggaaaagacaaccagcaaaggccaactctaagatgacccagatgttgaaattagcagacaagaactttaacagcaatagctgtgatcagttgggtaaaggaaatggtgattttaatgactaaaaatgtgaggactattggcaggaaaaaaactatatctacaaatatatgcaccaaatagatattttagaactgaatatgtataaaataaaaaaaaaaacactggatgggcttaattaaatgaagaaaataatcaatggctttgattaacagaacttttccaactccccaatctgagaaacgaagtaagaaaaattaaaccatgtctaaaggacccatgggacaatatcaaacagtctaaatacagataactggagtctcagagagatatagaataataaaaataaagaaataaaggctagaatttaccaaatttgatgtaagatataaattatcaaattcgcaaagctcatggaaaatcaaacatgatttaaacatgggaaaaagaaagagttgcacatcatagtcaaactgctgaaaatgaaatatatatagacacccttgctttagccatttcaataaagcaagaaaaagaaaaagcttaaagtttgaaaggaaggaatgaaactgtattttttaaagatgacataattatttataaaagtaagcacaaagaatatacaaaacaactattagaataaattactttagcatgattgaaatataaatggtaaatatacaaaagttaattgtatttctacatactggcagcaaaagctaaaaaaaaaattcaaaaataattctatttacaatagtgtagaaaaaactctcaaatacttagtaatatgtttaagaaaaggtatgcaatatatcttcaatgaaaacaatgtaacactgtcaagataaagaaaatctaaataaacaaatataccatgtttgcagattgtaatactcaatattgttaagatgctttctccccataaatttaatattgagtaaatgaaatacaagttataatcccaacaaggtttttttttttgttttggtagaaattgacaaggtaattctaaaatttatatgaaagtgcaagtaatccacaatagctaagtaattttatagaagaacaaagttggtagacttaacactgcttgtttttaagatctattataaagctgtagtaaacaagacagtgttgtattggctaaaggataggaatataaatcagtgaaacagaatagagtgttcagaagtatatacaattgatttttgatgtagttgtcaaaggaacgtcttttcaataaatggtgctggaacaactggagagccatatgctaaaaggaatgaacaaaagcccatagttcataccatatacacatattaactcaaaatggattacagaagtaaatgtaaaagataaatctataagctttctaggagaaaacaggagaaacattgttttgaccttggggtaggcaaaggtcatagatagaaaacaaaatgcataaatcataaaagaaaaaaattgagaaactggagtttagaaaaatgaaagatcttcttcttcaaaagacaccactaagaaaaggaaagacaagctacataatcggggaaaataactgtaatacatataatacatatatctgacaaagtatgtttataaagactcttacaacaatacaaggagataagcaaatacaaaatggaaaagatttgaagaaatacctaaaaatatatgaatgctgataagtacatgaaaagatcctcaacctctttagtcatcagggagacataaattatatcacaatgagatacaactgcacaacaattagaatggctaaattttaaaaagatcagtcttaccagtcttgacaaggttttgaagcaagtgaaactctcatttactgcagatgaaaacatgcatcatgtatccactttggaaaaaaaccctatttctcaaaatgttaattctacaacaaccaaataacccagatatcccattcctagttacacaagagaaacaaaaccatatatgttcacataaagacttctgcatgaaagttcacagcagttttatccacagtagcaataagctgcaaccaacccaaatatccaccaactggttggcagataaaatacagcatatttaggccaggcgtggtggctcacacctgcaatcccagcacattgggaggccaagcagggtggatcacctgaggtcagaagttcaagaccagcctggtcaacatggttaaaccccgtctccactaaatatacaaaaattagccaggcatggtggcaggtgcctgtaatcctagctactagggaggctgatgcaggagaatcgcttgaacacaggaggtggaggttgcagtgagccgagatcgcaccattgcgctccagcctgggcaacaagagcaaaacttcgtctcaaaaaacaaaacaaaacaaaacaaaaaaaaaaggatctactgacaggtgtaaataaaggaagaaatttcaaagtctttatgctgaatggaagatgtcagacacaaaaactacatactgtgtgagtccatttaaatgaaattccagaaaagacaaatctaatctatagtaacaaaaagcagatctgtggttgtctgatattgtaggtagaaagaaggatgtactgtaaaaggtcgtcaggaatcttttgggggtgaaggaaatggtcactggtgtatacatctttcaaaactcattgaattgcatactctaaatggatgtgatttcttgtaaacaagttatactttaataaagatcatttttaagttgcatgtagaaaaatataagtaaagcttgaaaaaaatagggcaaaatttatatgttagtagtttttggaggatgaggtacagaacattttcatttttgtttatactttggggaattttagaaactctttttaatgaacattagtcttttttttttttaaaaaaaaagtctatgggatttatcagattaaggccagctttgtgtccctagtcaaatgtgtgactaagatgtgtgttttagtctaatataactcattatcgaatgacactcttattgttggtcagacttacgggcagagcagtaatcccagagggatgagtatcctcacttctcctctgcatttcaggcatgaaattagaacacagacaattcaataatttatcagaaattgtgtttttagcataacaattcttcctgcagctgtctggagaactgaggccctcattgatacactgcattagctctgaattgttttgtatattcaaaattcatgttatatatcaatcatggaatagcaaaaaattattgaattagagtcagaaaacctaagtttgaggcttttttgttgttttgttttgttttttaattctgtgttactgtggtagctttatacatagccctgaaattcttgacatacttcttactgagatacaggatcttcaatacttgaatctgggagggcttgttactgctttgactaaaagaaaatgacagaattgaggctatgtatcttgcatggccaggtcagaaaaggccatgcaatgtcacttagttctcctgggacagaaaccagtcactatccaagaaacctgactactcagagattagcattttggagagcccacatgtaggcacaccagtcaacatccccattggagctcttagccaacaactgcacccatttccagccatgtgagggggccatttttgatgtccagctcagttgagccttcagatgactacagccccacctggtgtttggctacaactatatgagacaccccgaagcaagaactgcccagccaagccctttacgaattcctgacccacaaaactgtgggccaaaggaaaaggttgttgcttttaaccacaaagctttggggtaattttgtatacagcaatcatcaccattaacagtgaccttaagtgagtcacttgagctctctaaactctaagtctcacatctctaaaatgggaatatatctattctaggccgggcaatgtgatggctcacacctgtaatcccagcactttgggaggccgaggcaggtggatcacttgaagtcaggagttcaagaccagcatggccaacatggtgaaaccctgtctctactaaaagtacaaaagttagccaagcatgggggtgcatgcctgtagtcccagttactaaggaggctgaggcaggagaatcacttgaacccaggatgcaaaggttgaggttgcagtaagccgagatcatgccactgtactccagcctgggcgacagagtgagactttgtctcagaaaaacaaaacaaaacaaaatatctattctatactatggtcacaagtcttaagtgagataatacatttaaaaggatattggaaaccttggacaacaaatagctgtagtttcatttattcaaatattgatttgtttactcaacacgttgtttgaatgcctactacatattaagcctgtgcagtaggctaggggtataactgtcaataagagacaattgctggccgggcgcggtggctcacacctgtaatcccagcactttgggaggccaaggcaggaggatcacgaagtcaggagatcgaaactatcctggctaacatggtgaaaacccgtctctactaaaaatacaaaaaattagctgggcgtagtggtgggcgcctgtagtcccagctactcggcaggctgaggcaggagaatggcgtgaacccagaaggcggagcttgcagtgagctgagattgtgccactgcactccagactgggggacagagtgagactccgcctcaaaaaaaaaatgcatatatatatatatattgctcccatccaagagctcacattcagatggaggaaatggtcaagaatccagaaggcagaatgaagtataataaggctacagcataggctaatgcaagagctgtggaacacatggcagggcctcactcctatctcctgggggtagcagaaagaatggtcaggatgtgagattagggttgtgtgtgtagtgaggcatgagaatggaggaaagatgatcacacacaagtgaaacagagattctggcttggctctagctttcagtcagtaagctgaaactagtaaaagaatgtgaacttctctacagagataagggttttcttgtgaacctatgtagattggtcagaacatacttttgaagcatgatggaggcactacagggtctttatcatgtgcatctttctggccacacaagaattaaacaaacacacaatcaggaacaacagattcaactgctaacttgaataatctttgccatttgcttgatcaaagctatagacaatgttaagggaaaagatttcatcaaaagttttttttttttttttaattctgcacaatgctagtctaggagaatggtgattctggaaggcaacagtggaagctttgctccaaagtccttgcaaaactgctctttccaagctaggctacatgggaatgtgcctgcctccatggcctaatagttgtcctgtggccagtagagttatttccaattgttcctaaaaagtctctctgtgtgagtgtgtgtgtgtgttgatggggttttgaggcagttctggcatgagccaaaaaaaaaaaaaaaaaaaaaaaaaaaaaaaggcctttcccattcatcgtttaattaggtctaacaattacataatgtaagcagaatgtcctattactgatgtataaagctttatgcttgggagatgacagtaacagattcacaatcaactcctgggtctctggacccagtgttctttctcatacctcttgtggacaatatggtaataggataatatggtaatatgaatgcttaagcatggggactggtggtgataacagtgaggttttcacagcagtcaagaaatcaggcaagtgaaaaacagagaggggctcatctttgggatggggtacctcagtttccccttagctaggaaaaattcattactctctgtggaagacacatgaaagtttctacacaaacaccaaacttaactagctcagatccaagtggaagggactaaatgtaagttgctatttgcactttttcttttctttcttggacaagtgtagggttttaaacagctctgggagatgggaaaaaagcaaagtggagaaaaaaaaaaagaaaagaacgaagaaagagaaaaaaaaaaaacgcaactccactaatacccaaagttgtgtcaacaggctgttttaggaaagaatgagggactttgttgagagtgggaagggctcccctcacctactgcctcaagatgtgagcagaggctttttctctccctgagctcctgatatggttcctggcacatagtaggagctaacaagtgttggctagaaggaataaatcaagaggagttctcatcagcaccccctaccccatggtactgcagatgttttgatgagatgttttccaatttaatcctgtttgctgagttattagcctgttaatctcaaacataaataatctaccatgtgctgagagtctgactttttctttccctgagctaacaatccccaacagctcttctacgtttctatcccaggagaaacagtatgctttctaagcagccgtcacactccatctttcttcagacatggcactcattcccagggtgaacttcgcaggctctgggggtaagagccacccaaaggcccctgcgtctcatggcagcagggcagaatgtaggggaaaccccttttgaaaatcaccgttatattaaaaaaataaataaataaatcctgacctcttcacaaacccaacgaggaaaaaagtgccaggttgttcaaagggattcactgaccagttataaggaaagctcagtagccgagacctaggattcttgggtctacatcctggttctatcagtgttgtcatgcgggtttaagtaatttaatttccctgttttcttttataaaacaaaagtaattctatatttcccatatggtttggaaagctactattcagatgagaggacatcacatggttaagccagagttcttttttgcccttcctaagacagctactggcccagttgcccccatcctagatctccagtcatgaacttacccagaccaaaacatggtagtcatcactgatccctttttttcctctcctagaggacagccaatccagatctaagtcccattgtctctaccaaaaaatcctaaggtttgatcatttctcatcacctccacagctgcaacattagatgaagctatcatcgtctgtctattttaccacaaaatgggctttctgacactctccaggcttctacatttatattcccaatgcctattccatgcacaaaagttagagaggtcagattataaatgtaaatcaaaccaagtcctttccctgttcactagtctccaatggatgctcatcagctgtaaaacaatactccaaaatccacagctggatcctaattatgtaaccccaggctatttttccatctttttctcttcctgcccttctcactcaccctggtcttcctgcaggccactgaatacattaaccttgttcttgtctcagggtcataatactgttctttctcttcctacaatgttgtttctccacaggtctctgtgcaactgtcacctcctcaagaagccttctctgaccaccctaagatactcccttcctccacctcctcactctatctttttaccctgttttatttttcttcataacatttattgctttctgagatgatgtcatatctacgtttattgcctctctcttacagaagaatagaacctgcaggagttcaggacctttgtctttttatcaccatactctgcattcacttaagtgcccagcattgggtaggcattcaataaatacttgttgaatgaatgaatagataatgcacagaaaaatttaaagctaaacagtagaaagaaaaattgtaaattgcccactctgcctgccctctcaaaacagaaaaggatttacatgcaggtttgaaaacatcttgcaaacacatatacttttggaaactcacctgtttgtttaaatgaggaactctctggggagatgaaagaaatgaattttatttgattaggcatggtgtgctatttcccaattgcttctgagtttgcagaaactggcttcaggttcaaggagtgggaatgcccaagcttcctgtagccaggacaaggaggcccctatcatgtgtgttgaggagaaggtaaactagggtgtggcctcctgatgtcctgaccctctccagcacctccttctccttactctctcctgcatctcacagctttcactccacagcttgcaatcaagcctacccttacaagtgctagaaagaacacatgcaatgattgggagctagatttgagtccaacttcttccttcatgtctgattttcaacaaattattaaacctctctgaatctttttaaatataatttttacattatttgaaatatgagaaagagacactaatcctcacctcaccagccttcctctgatagatgggatttgccagagactgacaaaaatgagggcatcccaatgtgacacaatgtgacacgcatgttatcctgaatttcataggaagatggggtttgactttagaagctttcctatgggtagattttgcaagatggaggtgaataaacaaaatagcactatagcactagaatgtgaaaaggtaattccctcacacagctattatttcatatgaaaggaaatcatatatagatatctctatatatttgtatgtgtgtgtgtgtgtgtgtgtgtgtgtgtatatatatatatatatatatatatatatataccctgagtatatatactcagagattatgtaattgtgaaatgctgaaaaattacaaaatattttggctcctattgggtgtgggggtgggaataaaacactggactggaagaaggtggtggctcattggaaaactttgtcatatctcttagtgaatgactggaaactcaccttcccacacgtgttctgagaacttcctgcacaatgagtcatcacgttatgatggcaagtacttgctcacacctacaacatgcccactttctggacctgaaccagttttcagacttgtattcaccaaccaaaggagagcctgggtgcccatgaggaaggccaccatgccacagtgagtgtatacagtaatgtctcctctaggccttcctcagagggacttatggacttttatttggacaatcatacaccagaggaagaggaacatccagacatttcaaagaccattgagtacaagttgacagtgatagcagagaccccaggcatacttagagtcggggaccaaggggttccaggtaacagaatggagtcacaacctaggtgtagctcacagtgggaggatcctctccctagcccccaaatgtagaattgacacagccatacttggtggctggaagaatcctcctctcattgtttctttggactctgtgttaaaactatcataatggggaaggcaagtggagacatttccattgccacccaagagaggaaactaaaactaaagtctcatcctgtaggtaatggaagcaatcagtgctatacttacagactttaaggatgcatgagtgatggtctgtatcatattcacatttaattcaccagtcttgtcccttcaaaattcagatggattcaggagggtaacagtgagctaatacaaactcaaacaaattgtaggcccaagttttgcagttgtcagatgtagtgtctatgctacaggtaattaatacagcctggggtacacagtatgtgtccattaatatggaaaataagttttttcttttccatctctatctggtaaaattattagaagaagttcacatccacatggggtaggcatcactacacatttgtggtcttgccccagggctttattaactgttctaccctctgtcgttacataatctgaagaacatggaccatctagatatttcacagagtatcacattggtctattatgttggtgcatcactgggctagaggaacaagaaaggaaaaatatgttcaagattttggtaagatatgtgctttagaaggtgtgagataaatcttatgaagaatcgggggttcactacatcagtgaaaattttagagttcagcagtctgtggcatgccataacatcccttgcaaaataaagaataaattactgcatctcacagctcacacctccaggaaggaagcagaatgcttggtaggcctcttttgattctggagacagcaaattacacacttgggaatatttccctgacccattttccaagtagcatggaaggctgccaactctgagttggatcacagaacaggaaaaggtgctgcagcagttaggctgtgatgcaaacaaccctgccatttgttaccatatgacccagtggaccttgtattagtccattctcactctgctataaagaaatatctgagacggactaattcataaagaaaagaggttaaatcatctcattgttctgctggctatacaggtttctgcatctggggaagccacaggaaacttacaatcatggcagaagccgatggggaagccagttcatcttcacatggccagcaggagagagacagggagtgagggtagacgtgctacacactttcaaacaaccagaactcctgataactcactcaccatcttgagaacagcaagggggaaatccgcccccaagatccaataccatcccatcaggcccctcctccaaaactggtcatataatttgacatgggatttgggtgggaatatagagtcaaaccatatcacctgtaggataagagttcctggtgataataaatactgtgtggattgcaagttccaatcaggagacacacaatgtagatctcctgctctcagagtaaggtcatgccttctgcagcagaaagaatgcatttgaaagaaggaactttcccgtgaaagtttcaggtatgctattggatgctatcaagaaaacatgcagccataatctagcagaagtcatgagctggttctgtcagaccctctgagtcatgtggtagagtatgactctcacataagatgagagtggcaaatcacaattaggtccaagcaagctcaagggatacaaataaactgcagtagcagatggcccaggtcccatagcatccaccacaattgcactagtgcctctcactcaggttgcatttagggacacctgggagtggggagggaaaaggataagcttattttgaggagaggtattggctctgtatatggatacaaggatacaagctaaaaataggaccactgctaagcaatgggcagcagtctgaagtgtccacatggtcattgactttgtggggaaagagaagagatttaaggtgtggatgcatgattcgatttactggctaggggcttgacagagaaagacaggacaatcctcccttttgcttgttcaacaccaacttaaaagactttatgaagtcaacagggtggctacggctgtgttcattgctggtggtgggtttatggaggaggaggcaaacagagacactgtggaacttcctccttcacttttagcagttcagacacatgccacaactcagtgctccatgcgaaacatgtcccaattccccggagcctgcttacaaagcttttaaccctcaatgtctttcaaactgactttgatcatccatataaaacagaatagcaccaacacacacagaccagatgaggagcagaaagctccaaaaggggctggaatcagtgacctccaggatacccctggccctgagattactgaagaggaagccaaggatgggaatatcttcctagtgcagtggctctctcacttaatcatgtatcaggatcacctgtaaggccgttaaaacacagatcatcaggctccaccctacagtggcaggggctgagaatttacagttctgtcaagttcccacgggatgctgatgctgcgtgttcaggagctaccctctgagaatcactgtcccagagcaatgaggatgcaaaaacagacctgtgggcaccactccaagctttagcaccctgtgctcaagcagaaggcttccatgagagaggccatatgtgtcacagttaagagactggactttggggttcaattaatctggttcaaatccaggttttgccactgaccatctatttgacattagacaagtgggtcttgcctcgtgagccaaaattttctcacctgtaaaatatggataataataatatatacactatgaaaatattgtgaagtacagttagataacatatgcaaaatcaaaagatgcatggtaagctcttgataaataagaatacaatgacaacacacgatgctagtgttactaccctgtagagtactggctgaatgtaagaggctgtatttctactggctctagcccttattctttaatttaaatattcatctttggagactcagagaggtaattacattaagaggcaagcaaagcaaagagactgtaattgggactgtaactccacccttctccattcctccctacccacctctcctcagccctcttctccaaggtcagtttgtttaaattcggacttggacttcaccaggaattggtttcacattcttcttactcactgtatcaaatgagtatgagcagccatattctttcctctcatctctgcgacatgcctgtctgtgcttttggaggctgatgtcaccacagcagttaactcacatgcctggcacgtagcgtacacccgaacaatatttgttgaattgcatcgaatttataggaattaaggagacaggattttggatacattttcatctctgtggtgcatgaccttggattagccacgcccccttctccaggtctcagtttctcacttgtgaaaacagggatttctcaggcttcttccagcttagctatagcatagtgggcagagatctgaactgggagtcagtaaaccagggttgggggcccagatatgccactaactcatggtaaaaaagttgctttccctctctgtgcctcagttttctcatttgtgttatgggacgatttctacatacccacctcccactccacattcctgaatttcatttaaggccttttgagggttcaaggtcacagcctttaaacagtatttgccataacaggaaaaaagatatgattccttctatcatcttgatgtggccacattttactggaggcttctggaatcttgctggataaaatctcccataacaactcacagcaataatgatcattaatattgtatataatcattaaaataagtagcatcatattactttcaacttaaatggtatcttttagctgagagtctgctgatgctttagcatgacaagtgaaggaaaggaggcactgctgttggagttgctcacttaaatcttccttacatgcattttaaacctaaaggaagagatgggagaagttatttgatatagcattagattttgttttagaagctattgcttcacagaggttgaggctgtagcgagccaccgttgcaccactgcattccagcatgggtgacatagcgagaccctgccaccatgaaaaaaaaaaaaaaaaaagctgcatgtggcatctgtgccaggttctgttactttccagctgtatgattgtggtcaaagtgacacaacctctctgtgtctcagtctactcacctgtgaaggcttctctgcacatttcacagggttcttacaaagatcacctaagatagtaggtgcaaaaatgtgttgtcaactgttaagctctctacaaacacaagacattgccattatggtaataaaaatcaaatggcacatgaatatttcagaagcaaggactaggacagatgtgtaaagtattcccttctaatggggttttataaatacatgctccctcttcttattactaacttcttaataatctctttgcaaagcttgtcttcaaacaccctttgtctcccccatcatttcttcttaacatctcctctctcacacagctatttacttttgaactctgggtggcatttggggagacagttggttagaaaaatatacacatacatattttgtacagagacataaacaaaatgtatccagggcacctcaattctgagccaagatattaaaaaatatatatcttctttgtgatctgttgcagctgctcatattagcaatacttagtctgaaattaggtttaacaactctatccctatatgtagccacaaatatgttcacatgtggcattaatgtggaaagaaaacaaatgaaatatgctcagatgcattttcattctgttaaatcttaaagaaagaaagggttttacaaagccttttggagtctctcttggctaaaaaggaaatccttttgccattaactgctcctgcagagagagcctgctagctgcaagatcatgatgagggtaagcattaattaaatctaactgcgagagaataattatgtacacatatccgtcagggcaggttgtcactatccagtaacaaagttggatacaaactccatcagcagaactgtcaggcggctgttaaaaggatataaatgtgtcccaaaaggatcatttcattgcggcgggggggggaattggattgcaaaggattaatgaggcgaggggtttgtgttttcaattggatgtaaaatgcaaactaagttgtggtatcatcatttaaccttaatgtttagctacatttggatttttaccatgtgatggggacaattagaccttgtacatcaaaccagcatttttccatcatggaattacattaaaggttagttgtttttttcttttaagttaaattgcacaaaagtttacaacaaaatcataaaacccagtttacacagatggcatattcttaataataattaggtcagaaaatgaatatgaatcccaccagagtaattaggatattcagtaaaggaccctttttgttgctgccttatttctgtcaagtttcagtctaagctctgaggcctatgtatgtgcagacatcccacacaggtaatgtgaatgcaagtcttggaggtatgtgctgctaacagacacagctacaatgtagcagaaggtacaggagaactggaagcagtcaggtctaaatttacctccaagctcctggctgtgcaagtttgggcaacttacttcatgtctctgaacatccatttcttttacaaagtaagggttagagaaaggttgttacagtaatacatgtgaaactcattactcttaaaagagtaaagagcacaaaagaaatggccaataattgtggtttcctatcagatatatgtcccaaattagaaagtagaataaacaaaaccatgacactagctttgagattcattcctcctatagtttcatctttgttggaggaattaaagagagtatttccagccaaggcaaaggagtaggaagcctaactggtttcactgcagacttggtggacaactagaatggttagcaccaaagtaatttactccagtgaacgtttaataatctgtaattattatacttgaatgcttgagtgagtgattgattgactgtctgcttctttctccaaatcttgagttacatagaagtgaggacctcatatgtctagatttccattgcagtctcagggctgagcatagtgtcttacactgagtagacattcagctgaaagaataatgaaagtgaggttggagaccctgggtaggtagttaagcttagacagaaggaataggcagggctagaattggggaaatgggaattagtcacagcagccctaaagagcagtttggaaaggtatcatcctacggcaggataattgctctgacttggacttgtatagctctgctgggaccacagatgctgatctaagaatgaggccaaagagtctatcagagatcttagccatcctgggttgctgtagttattggtataattacctactcttgaattctctagatcttgtggagttatttctatgtagttctgcctgaacgcaagatgatttctttgggacccttctccatgttacaatctgtgaaggttgctccgcaacactgcactgaaagggagctcaccagcgtttctcggctaacaccctcggcaggtagcaaggctgatacagatacaggaaggggtcaggtgttacagctgctccctgcaaatctttataactagatcacacataggtaatttggagaaggctctttctctctacggaaaataccctgacaaaagctttatttccatggttttgtaatggcccaatgggttcatcttgtccattgcctagaaaagctaatgcactgagaacagcagatttttacaatagagagtttaattattgcacagccagctaaatggaagactggggtttcattactcaaattacagtctccctgtgatttcagaagttagggttttttttttgttttggttttttttttttttttttttttttttgagacagagtctcactctgttgcccaggctggagtgcagtggcacgatcttggctcactgcaagctccacctcccgggttcacgccattctcctgcttcagcctccccagtatctgggactacacgtgcccgccaccacgcccacctaattttttgtatttttagtagagatggggtttcactgttttagccaggatggtctccatctcctgacctcgtgatccacccgcctcggcctcccaaagtgctgggattacaggcgtgagccaccgctcccggccgggttttttaaagatagtttggtgaacagggagttagggaataagaaacacggattggtttggtcagggaagaaatcatagggagtgaaagctgtcttcttgcactgagtcagttcctgggtgggggctacaagaccagataagccagtttactggtctgtgtggcaacagttagtccatcagaaatcagggtctgacattctggccaacatggtgaaaccctgtctctactaaaagtacaaaaaatagctgggcatgctggtgtgtgcctgtagtcccagctactcaggaggctgaggcaggagaattgcttgaacccgggaggtggaggttgcagtgggccagatcccatcactgcactccagcctggtgacagagtgagacactgtctcaaaaaaaaaaaaaaaaaaaaaaaaaaaaagaaatcaaggtcttaaaaatacttcaaacactaatcttaggttttatgacagcgatgttatctataagggcaattggggaggttaggaatcttgtggcctctgactgcatgacaccagagccataatttctaatcttgtggctaatgtgttaattttacaaaggaggtctgatccccaggcaaggagtgggtttgtatcagaaaggggttgatgccatctttgtttcaaagttaaactataaactaaactcctccatagttagcttggcctatgcctagggttgaacaagggcagcatattagtccattttcagactgctgataaagacatacctgagactgggcaatttacaaaagaaagaggtttaattgaacttacagttccagttggtgtagaagcctcacaatcatggcggaaggcaaggaggagcaagtcccatcttacatggatggcagcaggcaaagagagaatgaggaagatgcaaaagcggaaacccctgataaaactatcagatctcatgagacttattcgctcccatgagaacagtatgggggaaactgcccccatgattcatttatctcccaccaggtccttcctacaacatgtggaaatcacgggagtacaattcaagatgatatttgggtgggcacacagagccaaaacgtatcaggcagcttgaaggttataagcaacatggaattggttaggtcagatttctttcattgtcataatttttgtaaaggtaatttcaatttgaagcagaaatatgagatatatggattgaaggcaaataccacttctttgcattgacagtgaccatttttctagaaatgttctccttaaccacaacctctgccatacccacttcctccctccgttcctcaaaaaacaaacaaaaacataaaatctgcacatgaattgcttctccctatctccaccccttgatgtaaaataaacgactttcagacagataaaaattaaactacatctagccctaaatgttgcagagtcatcactgaaaataaaataaaatattaagaaatggccaaagccagaaaattgaggttataagacatcaagatccataaacagaatttctctcttcttaagaaaattttttaacctctaatttttgagggcagaattttatatatgtccattttattatatctttaatagtgtagttaaatttttctatattattattagtagtagtttctctacttggtctaataggaagatttttgtaaaatgtctcccacttggactatgtattaatcaacattccctgtacttctctcagttttttcatttaagcattttgaaaccatgttgttcctatatgtaagtacaaatttcatttctctcccagtaaatggtttcttttttggttaattaataatactctctattcctaaggatttttccttgttccttcttattgttgtaaaattaattttgccatatgattccatttttttataagccttcatttgattagtattcacaaaatatatatttttcctttccctttccctctgtcaaactttgtgtccttatgctttagaatgatctctgggaaatagtatataactgaattttgtttaatatatcctatcacagggccaggcatggtggcacacgcctgtaatcccagcaatttgggaggccaaggtgagcagatcccttgagctcaggaattcaagactagcctgggcagcatggtgaaaccccatctctaccaaaaatacaaaaaatttaactgggcatagtggcatgcacttgtggtcttgactactcaggaggctgcagtgggaggattgcttgagccctggaggttgtggctgcagtgagctgaaatcatgccactgcactccagcctgggtgacagtaagattgtatctcaacaacaaaaatgaaaataaaaataaaaactatcactgaatcttaatgtgcaaattatatttactgtaatttctgatgctttggggtttattcctatcactttatctttcactttttccttgctcaggctttctctctacttgtatcccaccccacctgaccccctacctggagtcatcatgacaccagcttctgaactcatagcttggctttgcatttcttacaacttatatctgcattccttaagcccggggggcttcctttctttacttttgggatgaatcttaattttttaaaaagtatattttgtccaacatttattttgtgtgtatggaacaggaagaaggctcatgttagctttgtcagccatattgctgaaagtttactacatgacttgcctgttttctttccatgtaggaatgggagcttttgctatacacacacacatacacacatacatacatgtgcaattgcagaattgagatttttctatcaaaatattgaagcccaatatataaacatagaataaaagcttgattaaaaagccctacctattcagccacagttccccttccccttctccctgagcacctatttgtggcatgcttgaaaacatctgctaacggcccaggcagtctatctcatatcctcactatgtttaatcatgtatatctcaatcatgggaaattgtaaagcttctctttgtagtcttctaagtgatttatgcagttgattacagctgaattagaaaagagctgaagttgtcaacttctaactatgtattttgttaaatttcaccaacagtcagtcctaatgtaggtaatagggcctatgtggaccaaaaataaaaccttaagcctgcccaacacactgaatgaatcccctaccacactcaaagccaagagaaacctgaaaagctgaatttcccattatgatgaaaagggcagtcagacatgtctcattatacccctcttcttttggagtttaggcacaactgaccagcattaatattaaaatagagatcaaaagactgacaaaatagatgctgtagcaataagacaccgaattccaacctgactctgatgtagtaacacatgacaagtgaaggaaatcaaaatattttaccccaaaatatattttcttgatgtattttgaaatggccttgcaaaaccatcttttgtggggaaaatttgcatctgtagagaatctccttccctttctaggtctttctgcaaatccaggagaaattaaatgagagtctggtacttttaaggtcttaaaaagtacatttaccatattctctctaaggttactgcctggaggcttcatctacataacaagaaccttggcatctacaacccccattatcttaactcaagcatttacttcaagtctttagataatgtttaactcaaccaattgccaatcagaaaatcttttaatccacctatgacctgtaagtacccctgaaccaatgtataccttacatatatcgatttatgtctttgcctgtaacttcagtctctgtaaaatgtgtgaaaccacactgttactctcaggaacactttctcaggaccccttgggactatcatggtctatagtcactcatattggcttaaaataaacctctttaaatattttatggattttggcttttttaaaacatgattttatatggtcaaatggcataaatagccaatgatttcacaaattagaggacttgaattattccattcctggatctgctagtttctctgtgtgacatcagtgagtccctgtctccatcatttccacatatacaagcagattggatcagacaatgaagcagaatgatgatgtgtaccttttgggctcaatccaaaaaaccttgcagctcctacttctgctgtttttggatctcccaggcatgtgaaccaggctgggatagctggctagccagaggtgcatgagatgtcagctgaacctaccccacccagaccagaactaaccacctggagccaagcccaaatgtttttattgaattaagtgctaaataaatgggtgctattttagttcactacgttttaggttgttttattatgcaacaatgctaacatagcattattaccattctactgaaagaaatatggtagagttgtatccctaggccccaccaggatctggtcgtgagccttccgctaaggctgctttcagttgcctctccatcctccaggccagatagaattgactgagagccccctgatgtatttcagatggacaagaaaaagctcctgaaggagacatacactttcaggaacacaaacttctctgaaagacacatcagggaagatttatggaggcagttgtgtgctctgactgctgatcagctttcttatgtctcagtacaatacaacctgtgggtcaccgggttggtggtggtactctccccggctgcacctcttagaagagacctgaggtcaacagacagaaagccagagactgagggaaaaggtttcctaatcaaagatacatgccatttcttatctttgaagatgccagggtgccgattccaggatgcaacaaatctacagcatgctttaaagaaggatttccataagcatcctagcatattctcacgacagtcctggacaaaagaatggcagatattctcacatccccagatactggggatgaataatatccccaggatattaaggatattaagcagtttctctaaagatcctccctgagtatccattgcacttagggcagggttggggttcaaaccagaagtttctgactccaaattctgaattgtttagtgtacaacaatatttttcaattgtatgtatcatcaaagactatttgagttgggggagacctgtggaaattatctagcccatcacctttgctttccaaattaacaacaacaaagattcattaggtgcttaccatgcttagtacagcctgcggagcactttacaaacattaactaattctcccagcctccctgtgaggtgactgattgtatgatttgtagattaggtaatggagatttgatgcataagtcatttcccaaagttgagccagtcagtggcagagctaggatgtgaatccacatctgtctgactccagaccctgagcacactgccacaatgccatatagccttttagatggggacactgaggcccagagagtggaaggtcttgtccaagatcatgaagccagtttgattaattgtccattaattcatcaattattgaggatctgctatttgtcaggaagcaggctagccaatgggaacacaggcatgacctagatatagttgtgcacttgagagtaattaagggagaagataagaagtgactataaattacttgaataaaagatagtaaatgacaaatatctcagggaagatagtgaagaggttgtcaaagtttggaggaggtatgcacgactttcatttgggaaaaatttgaaaattcttcacagagaaaatggtttaaaggtcttgtttgaaagaagagtagaatttgcatattggcaatgggaaagaggaagaagttcaagctgcaaaaagcgcatagaggtggaggtaaaaggagttatttcatcatagactcagggctggtctccaggtagttgtgtctatccagtcctccttgtaacccctataactatctcatggtttaagtggaacctcattttgatgatgcaatgtcaaaacttcctttgtcaaaaggggcggtaaacctaaatcccacccaaaaatccttggtaggaagggaaggctgctaagaaggacaaagtgtagggaagcaaagatggggaccaaagaaacaaaggaagatcaatcctgggactacctgttcaatatttaagcagagcaacgacccattaaggcaactaatttaaagtcgctaatgtttctattttcttccaactaattgaataattcatgaccagttactaatgaaaattatatatatatatatatatatatatatatacacacacacacacacacacacacacacacacacacacacacacgcctgtgttccagggacagtgtcccacagtaaaagcacattgaaacattgaagcttatctatcaagaaggataaaggagccagaatttgcttctcctcccaactgtgggatgctgctgggaaatgtgtgagcaagatccaaagatccagggtctgattttgatggaggattttgtggcttcccatcttcccactggcacctgcctggatcacattttcccccagatattcccgttaccccctgcacagcttcatccctatgtgtatttgcatattttctttattctaccagcaatgtcttcccaaactttctctttatttaatgcattacttaggattacctgctctgtgaagccttctttaattattcccccagtttagtaaataccccaagccagcccacaccaccttcatgtatccattgtggtgcagatacgtaatgccctgcttccttcaataaatggtgaagtactggtaggccgagatctagttggcatataccacacacatgtggcaaactaaaaacattgagagtggatgtcttaaaaaatgcacagagcactatccagtgacgtaacactgtgggctcctgaggacatgggactggctccctggggttagttaaaagctgaggggacagtgctgattcattcttagctcagagagggagatgcctcaccttctagagcctcatagctcctgaacaccctcacagcagcactgatgacacagaaacactgccaatgcaagagaagctgcacgtacttccttccaggatctagactaggtaggtataatttcacagctcaaagatcttagttgtggtagctaagagtagagctcaagtcatctgggaatttaaatgtgggctctgaattcatagctccactatgtactagttgagtaaacttagacaagtgactgaaactgtgtaagcttgagtttccttctttgttgaatggggataattatagtacttaccttatgggttattgggaagttttaaataagataaaatgtgtgatgggcaaggtgcctagaacataccaaatgctcagtagatggtaggctgcactgcatcccattaaccgtttgcatactgtgagctcccagctacctccctttatctatttacccgtctccatccattcattaatttattcatatattcttccattaaaccaattactatcccaagccagttccctgttaggcattcattctacagacagacataaatcactgttttttccatcatgggactgtgagagctgaagaaggtgacagatgtatttacgacagactgcaataagggcagtgataaaaaacagtactggggctatgagtgctcagagaaaagagtggcttgctgggctgcggctgcggtaggggctgagaaaatgcttcacagagcagatgctgaggctggattttgaagataaacagcaattttttgcctggagagaaagggtggggaggaggaaagggcctttcaggaagaatatgatcagcactcggacctagaaagcaaggcatactgggggaagggagaaatggcccatgtgctggaggctgtaggacacaatgggttgggggtcaggagtagacagaggcagggtacagcccaggctaggagggagccttgtgtagcaagtgatggcaacttttaatcccattaaacaatatgcccttcatcctattggttcttgcttctataacaaggtaaatgtatctctgtgaggtaataataccgataaaaataagactaataatcatagcaatgatcagaataataaataacacaataaaagagcacatatgttcagcatgcaaatatgtctggctctgtgctaaatgctttactgggattatcttattctggcctatggaaatcctttgaagatggtagcattctcacccccttatagttagttaaatcatggttcttcttcctgggacatcaatattgtatgaggaattgagcaagtgttaaattaattaactgaaaaatactataacttaaactaaaataaacatgcatatactatgaaataaaatggcatgatcttttaaaagatgaacctgaaatgtgaactttatgacagattcttttgagcacagctgcagaccctctgggggtaagttcattttcatatgcctttaagaagacttcatttcaaaagctcaagaggcccccagtgcaagtgacagaaaatcaggacaatgttctaggtgggggaggaacatggccaaatttactgtgttttcaaatgatcacccagctgtcagggtagagcatgcatttatcggtgccaacgctgctgcaggaatctggatgagggacaatgagacctcaaccaagctagaggcagtggctcaggaaggggaagatggatttatgagacgctgcaggccaatgggcaggacttggatgacagtgattgtactagctattccttattgagggttgaacgtgggacaggcactgggctaagcatctcttgggtattaattcacaacccacatgtgatgttggtattattagcactatttccagaagggaaaacagagctcttattaattagcttaagagcatttagttagtcaatggtggaattaaatttcaaacacaaagtcccgctttcaaaaaccgctacctaaactaaataaacctatggaatttcttctgtacatccaaagaaatcttcctctgctttatttgaatgccactgtcctttatactgcccataagatgctggggagtggctccttaatagcagcctcataaaaccccagcactaacatgaagtcagaagttcaaacctccactatccttcctctgtctggctaagaatgatgcacttcagcctccaccaggcctctcaggaagaaggcatagctacaaaaataccttggagctgcttttaaccatgtgctcaattccatggcactggttctcggctacccattccatcttctggaaactagtgggcaccgtggcccggggatgaggcctaaggaagcagaaagagggcaggtgctcccaatctggaccaggcagcccacggcaacctcaatggcaggagagggcagaaacagtgaaagacagaggattcagaccatcctatttgggattttggaggctaatggagcatttccaaaattctgttcctatagatgcttctgttcagcaagtcattaataaatgttccaatgggagaaataagagtttgcagtcaacatagtatcaatacattgagttaaacaaagcagcctagctttctgtactgcaggacttctcagagtttttaatagactaagattcattcaagaatcttcaagagaaagagggagggtggagaatttccaaacttttttttttttaatcatgaaattcttttgtccaaggaaatcttgatgggctgtcttgggtaagtttggaagtatagggctgacatatactgtccttactcttctcctgcagaaattgtatcccatggtagcagcaaaatcacaagcatactgtgattaagctgttttggaaattgctttaatagcatccacttgagcacatttactgtgctacttgtcagtgagtctaagggggaaatagaattctctgggcgttggtaccaggaggatttggtttatcacagattcctcttgcaccatcaatatgagagctataaagctgagccattttccagtgatctttgatgttaatacgctcatttactcaactaatatttattaagccatttctatgtgttagatttataaatatgaatcttatattttagagaggaggatagtagacaagcaaaaatttaaaattttagtctgaactactactgtggaagaagttaaaaaaggagggtgacgtaagagatagtagcaggttggggactgaaaggagcaaaactgtagattgggtagtcatggaagttggtttttaggagctgacatttgaaaggcgagaaggggctggctaggagagcagctgggggaaagaaagaggcatggcaaggagaaggaggaacaagttctcagatgctaaagaaggaaccgtttgctgtgttggtgaaacgtgaaggaagccagtttggctggagcacaaggaagtgcagagcaaatgatgttcgaaaagagggcaggagccagagccagatccgcaagccaaggtgcagagcttggatcatagtctaagaataacagaaaactgtcaaaggattttaagcaggggaggggctttctctggtttatctttctaaaagattgctttggtagttttgaggagactgaatgcaaggagagtatagttgtaaggagcagttaataaatgacagtggtcatgatggtgacaaagaggaaggacagatatggaagagatacaaataaatttcttcatgcatagttttctgagaccccatctaacttgtaaattaacttaaaacagacttttattaataatctgactatgaaattcttctctaagaggggaaacattttaaagtaagtggcaagttttatgcaaaaatactttctatgtaacattgtttatcatgatgaaatattaggagcagcccaaatgcctaatagtaggggcttagttaagaaaattatgatgcataaaaataatatttttgaaaaattcattgacataaaaatgtttagaatgtgatgttaaaaaatgaattcaggttggtaatgaagggaggaaaggctatagacttggagtcaagagtgtttatggaatatgtatgtgtggagaggacttaggagggggatttctggtgaatgatacagaagtaaagatgaataggtaaagctatacgaaatttcaagtaaccctaaatgccttacccagaacaaacataagattgcatgtattcattccctgatgcatgccatctgaactttccaaggtggtctacattcagccttttatcaggtcttcacaataatcttctgatgtagggcttggcatcctcattttacagaagaggaaactgaagttcagggagaaccaatgatacttccaaagtcatgcaagttaaaactgacttgggctgggattagcactcagacctgtctgactttaaggtgactgctctgtatcactacaaaatggtttaaacctggggtttcccatatgagttccaaaaacgaattccatcattttcttctgcctcaatttgtgatctgacagcttaacatgtagagcttggttttttacaggattcaagattttacaagattaagaattagacatcctctcaacagatagcaaacatctactatgtgtcaggcactgatttaggccaggaatgtaaaataataagacaatccctaccttcaaataactctctgtctagctaaggaaagagccagacaaaagacaatgatatcacacaaaaatgaatctagtgcttaatacatgtataaaggaaagctgggaggattcagtgaattgtgactgtgacaatcaacaacgtcttcatagaaatgtgccatgcatgttaagcttgaaaagacaggtagaatttcattagtgtatcaggttggtgcaaaagtaatagcaccaacataatagtacatagtcgttaagttaaaaggtttgagactcagactgccaggttctccctggccccaccacttactagaatgtcccctcagacagattacaatagctgtttgtaccttagtgaaattatctgtaaaatgggaattaccactgtacctgcttcatagggttgctgtgaggatcaaatgacataagatgcatatatcatttaagctgtttcttggaataagttaagagtcaataacccttaggggccagagaggtggtttcatgcagagagcatggcatgggaaacagcactgaggacagagcacaacaatctaggaaagacagtggagaatagagctctgtgtggctttgagtgtcatgttcatagcctgaacatgtgtgaaggtgctagataaccactgaagctgtgggaaaagggggatgacctgatcagagccaagttacaggaaatggagaagtgagaggcaagaagaggagactactagtttttctatctactcagctagagactactgagtagatagaaaaaaaaatggtttggaaattaagcagtgacaagttgatttccttcatatacgaagtcacatagatggtagaagaagaaagaagggatgaagagaaggaggaggaggaagagaagtaggaggagatgaagatgaaggaggaagagatgtagaaggagaaagaggaggaggaggaagaggaggaggaaaaggaggaggaggggaggagagaagagaagagaaggagaaggagaaggagaagaagcagcagcagaggaaaaggagcaggaagaaaatatctgctttttaataaatgctgggttaggcactgtgctgagttattcttacaaccctgtgagacaggagtggcttggagaagtagagtgatttgccctgagtgacatagctaggtagcagcagaaacaaaagttgaattaattctatctaatttacaataccactcttgatcattctgttattcagcctgctaaaaagtaggcgcagacccctgtttctggctcccagactgaggatgtctcctactagaatgttctgccactttgtactctctgaccggcaacaacttaaagaacatctactttgcagaggtcctggtgctacacactttccatatatagttgctaatctcaatcactgtaaaatttatactatccattctcattctcagttgaggcacctggggctcagagaggttagctctgggtgtagggagcataggtctgcagcctccaaggggatttatcagggagaaagtggcacaagttttatgagcacagggaagcaagggaagaatgcacagatctccctagcatctttggaatcagaggacaaccttctgacttcctggccagatgtgccaggagggcctacctcgagacttgctcctccgcttcctcttccctgccgatgtgctgcgcaggggtggttgcagctgaccgatctcgatgggcgtgttagcgcggaaactctccttgaacttctgcatcagggactccactgtctcctgagtcgcctcagctgctgctataaggtagcaatggggctgaggttagggcttgagcccaccctcagcacctagagcactggggctgaagttagggcttgagcccaccttcagcccctagagcactagacctggccaccctaattccttgaaactccctccctgacccattgaagatatagaatcaaaaccttgcagtctaactgcagatgtatctgttggattacatacttatgtattcaacatttactacgttccaggtactgctctaggcccttgagactagagggcttggtcgtgaaatgtgagacacaattcattattcaagtaattcttagttcagtaggagacatatccagacaattctaacattgtgcaatatttttgcaatagaagagtacaaaattccaaaggatcactgaaaagggtcatcacacccatctgagaatcaaaataggcttccagaaggaggcaatatttaggatgagaccttaaagatgagtaagaattagtaaagaaagcaggatcagggtgaggttggacagagcagagaagacagcgtcctggatggaaggagaagcatgtgtgatgatctgaaacgagaaggagcacggatgcttgagcattggaaagtaatttatggtagttacaagagagcttgcaaagaggaggcttatgggagatgagattggagtgataaagacatctggtaggccacatttaggagtataaattttatcctaatggcaaaaggtatcaccaaaaggttttaaacagaaaatctatgtgttcaaattaaatcactttgaaaacaatcactaactaaagtatggagaatgcaaactgaaggaggaaaggaggcctggactgaggctttggaagtagccagtcaaaggcaatggtggtctgaaccagggcagtggcagcgaaggtgacacaatatcttaggagacacaaccacagtactgtggatatgtcgatcacttagcaacatatacccattttattgaggggatgttgaagccccaaaacacaatatatgtcttactccaagataggaaatggcagagtcaagccttctaacaccttgtccaatattccgtttgcaccaataccttccaatgaattgttagtagccacatttccaaaaaagtttcaaagttgaaactggtagaaagttcagtacatggagaaagtaaggtcagaagggcagagagaaaaagttggaagataaaaggaaaaaaataacagaaaagcttgagaaggaaggaggcaacataaaaggcaagaagagaaaaccaaaaagaagaaaagaaaaattgctgaatagcctcagtgcctttgttctgagaaattcccaaagacagccctgactttgaaatcttcaaactcatccctccctccatctgtgtctccagaggctgggaaatttcttcttcagtttgagctacctgctgtctgatgccaagagatgggatgtgccaacaatttctgtttctttgaaggggcttcatcagactagacaaagaaggctcctgaacaacccagtacccatttctaaggcgctcctgttttctcagggaagcttatcaggttagacagatgtgtctgcagagtaagtcagacctagagggcttgttctggtattgggttctgtgagaagtcccatcttgagggttatagggaaaaggtatgattgctaaggtaaaaagacaattgacaatacaaatgaatcatgtggtggcattggtttcctcatctgtctcccttgctatctctctccacagatatcttaattaggtgtacttgaagaaaccaagaagattccagacatggggtcccttcttcaagcctgggatgaagaatccttcagctatagcctgcagtatgactctgagaagcaatgtcatgccaagttttgattccgtaaacccagagagaaaagtgctttgcccaatagatgggctatactttggtcaaaagtccagaataagccacagtttggaatcctcgaagggaatgacccacacaggatctgtcaatattcattcattcattcatttctccacttattcattgattcattcattcaacagaatttacagaaaaaaacattacataccaatgctgagaaccaaagacatagcttagcttgggctaccataacaaaatatcatagtctggttgtcttaaacaacagacatttatttttttcacagttatggaggctgaaagtccaacatcagggtgccatggttttggtgagatttctcttcctggcttacagatggccaccttctcctccctgtgtcctcactcggtgggggagcagggaaagagagagagaaagagagagagaaaaaaaaaacctctcccttcctcttttgataaggccaaagttcaatcagatcagggccccttcttatgacctcatttaactttaattacctcccaaagatcctatctccagacacagtcagccacggattgaattgtgttccctccttccccaatttatatgttggagccttaactcccagtgtgactgtatttggaggtgagggttttagcaggtaattaaggttagatgaagtcataagagtgggatcccaatctgataggataggtggccttataaacagggtaagaaagaaagaccccactctctttctatggacacagactgagggaaggctgtgagaggacacagtgaggggtggcatctgcaggccaggaagagggccctcaccagaactcgaacatgctagcaccttgatcttgacttttcagcctccagaagtacgagaaaataaatttctctcgtttaaggcacccagtctacaggttaagcttccctaatccgaaaatctgaaatccgaaatgttccaaaatctgaaacattttgagcatggacatgatgtttgaatgttattctctaaggcaagcttgtccaacctgcggcccaggggccacaggcagcccaggacagctttgaatgcagcccaatgcaaattcataaacttccataaaacattatgagatttgaatttcttttgctcagaaggtagagaatgattgataagggaaaaggagggattaaggatgactcctgggtctcctggcttgcacagatacggatgacagttcctcagtaagaggaggaacactgtaagagatgacatttgagaggagtgaacactagtttttttttttttttttttttttttttttttttttttttgagatggagtctcgctctgtcacccaggctggagtgcagtggcgtgatctcagctcactgtaacctctgcctcctgggttcaagcaattcttatgccccagcctcccgagtagctgggattataggcatgcaccaccatgcctatactatatataggatttttagtagaggtggggtttcattatgttggccaggctggtctcaaactcctgaccacaagtgattggcctgcctcagcctctcaaagtgttgggattacaggcatgacccactacgcctggctctttttttttaaaaacttttattttagactcaggggtacaagtacaggtttgttacgtaggtaaactgtgtgtcatgggaggttggtgtgcagagtattttatcacccaggtaataagcatagtacttgatagggagtttttctatatggaaacctcagaatgtctttgagacatctaagtggagatgctgggtagacagtgagttatgtggatcacacatgcacaggagagagctggacgctctggagactcaatacccgcattccttggaaaaggtagacagtgaatgtgggtagtggctgagaacatgagcttctgtgctggcagagcagaggcagcagaacctgtactcattcctagcttgtgctggctgttctccatttacactcccagatccacccttcaccctctgggctgtgtcacccgctccttgttagatggctactagttgggtttggcccgtgggatgccccagaaagatatgggaggaatttgaaggtatttctttccttgttcctttcctgtttcagtaccatgtttctgacagagactgagattctcaacaattacagctttctgcccagtgtcccttttccacagtcccagttctcacagggtccaataaaaccatgtctccctgccttttcagttctaggaatcagtagtggcttcctgacattcttgtcctggtaccttgaaattcctatgttgattctttttactttgcctacacctctataaatagccacttcattgaattctttttaaaaaaatcccatttgaagatgtgttctttgtctagctgggaccttgactgatatatcattcagcttccctctcttttttttcatggctctgacattcagcaattcctaaaggtcagcctctttccattttgcaatttctgtcttctttcttctaagctgatacagatttgagtggctgggaaaagaaggcacacagagaaggaaggggtgatcccctgagctgcaagggtttctaatccccactgtagcaaatcccatccatctgtttggctgctcttgcctcagtgacagtgccaagagcccaggcagacttagagggggaagtgctttgcaaacctctccatggccaatttcatcctgcatacaactccccctatccctgatccctcccgaccccattcagcagctctatcgatatcagtatatcaagttgtccaaacaagccacattacctcctggtacccgctgagctctgactccccagagcggcaaaatgctcacccatcgcctggatgaatgcaacagatgctgcttgatctgagcatcgcggcaggcccaggaaagggagggagaggaggggaacactgcctctttctaattgacatataagagattgtcaagcttaatggtaataaaccactggggcctgaggaagaaagccctggtccccaagccaagctagagagagaggacaggaaaggaaaagacaggatggaagaggagagaaaaaaaaaaaaaaaacaagaataaaagagataactgtgctcagtaataaagaagagaagacaagaaagagggggtctaagatgagtgggaagaagcagagaggcagaacacagaagggaaggactaaaaaggacaggcgaggagacatggaaaagaaaacaagaaaaagaagaaggcatagaagttcatggtgagggatacaagactacaaactgggttcagtgtataccgctcgggcaatgagtgcaccaaaatcccacagattaccattaaagaatttactcatgtaatgtaataccacctgttctatgagaaaaaaaattaaaaggatagaaggactaagttctagtgttctatagtgctgtagggtgactgtagtaaacaataatttattgtattttttcaaatagctagaagagaggattttgaatgttcctaactcaaagaaatgaccaagctttgaggtgatggatatgctaattaccctaatttgatcattgcacattatgagcatatatcaaaatatcataccgtaccccataagtctgtacaattattatgtgttcattaatattatttttaaaaataagggataaaagggggtggaccctgagtcattttgcaaaggcataagtgttgtatgggtttccagataccaggcaagccttagcttctaccctggagaagaggcactacacattatgtctacactgatactcaaaaactgtacacttaaactgtatatttaaactgtcatcctcaagacaagcctggccaacatgatgaaaccccatctctatttaaaatgcaaaaattagctgggtttgatgcaggcctgtaatcccagatattcaggtagctgaggcagagaatcgcttgaacctgggaggtggaggttgcagtgagctgagatcacgccattgcactccagtctgggtgaaagagtgagactctgactcaaaacacacacacacacacacacacacacccccgttatccaccgttctcttcccccacgcaaccacccaggacgttccaccgatgaaacgcatatgggtttgagttgaagttccagtatcactttgctcgccctcttcaattttttcagacatcatcagtctgtgacataagaaaattcacatttcttgagcaccaactttttgctaggtagggagcctggtatttccttatggtttctcacttgttccccctaacaacctggaaagttaagtattaataatttctgttcagagatgaggatagcaagactcagaaatgttacatggtttttccaggtcatgcagcttagggacgatagaactgggatttggactcaggttatggtgactccaatgctctggccttatctgttgctgcactctataagtactccctctctggttggctggagatgggtatgttaatcttggagtttggatgtgacatttctgggcctggatggtggctctgatagcttagctcctcttcagatcatctaggcaaagagccctaggaaatctggtgctgcctgaaaccagtgagtggcttgacttgattggagattagcctgttatgccagtggacccttgctcaagactgtccaccatggaggttccagggttgacccatgtctcactgcagaactgtactaagagaaccaagaagcaaatggacattgaccatattgcctagtgcaggtgagaaatctcactcgagttccagtatcaactctccatgtgcatggccttgagttacttctttcacttttgcaacccctggtatcctcctctgtaaatgtctgcagggttcttgggacgattaaatgtaattatgtacaaaaaatgtctaacagagcttctagaacatagtaaatgctcaagaaagagtagtcattactcatctttctctcactaacctgtcagcttcatgacatttcatttaactcattctttctcattcattttgaaatttttggtgtcataaaatagccactttgcaaactttcttagaaattatacattccccctttcattcaaatgtgaaaatagaggcaccaagagataaactcatcataaagttagcagcagaccaaggtctagcactcaaatctcctattccactactcctccctgctttcccaagttttaggataattttaacctcagatctgatagtcaattttgtgcgccaatttactaaaccatgatatccaggtatttggccaaacattattctagacatatctgtgaagattttttatctatatttttttagatgacataaacatttgaatcaataaaattggagtaaagcagaacattctccatactgtgcatgagcctcatccactcaagtgaacaccttgatggaagaaagactaacctctctgagttagaggaatatgctacctttggacttgagccgcaatatcaactcttccttgggtctttagcttgctggcctaccttacagatctggaacttgccagcctccacaatgacatgaaccagtttctttcttttttttttaattttaaatttatttttatttttattttttttgagacggagtctcactccattgcccaagctggagtgcaatggcatgatctcagctcactgcaaccactgcctcccaggttcaagtgattctcgtgcctcagactcccgagtagctgggattataggcatgtaccaccatgtccggctaatttttgtatttttagtagagacagggtttcaccatgttggccgggctggtctcgaactcttgacctcgtgatccacctgcctcagcctctcaaagtgctgggattacaggcatgagccactacacctggcctgaaccagtttcttaaaataaatctctggttagatagacagatgaaaggaaatagaaggatagagaatacatataactaatagggtgttgtgtgtgtttgtgtgtgtgtgtgtgtttgtgtgtgtgtgtgtatgtgttcatgtcttcttggttctgtttctctaaagaactctgaccaatgcaacctcagtttgtgtcctcgggctttggactttgcacagtcaaatgccaggactggggacaaggtgataagagaagacatcttagtcctaaggtacacctaagctgggaagacccaacataaatgcaaaaaaaaccatccaatttggaaattgtgagagtccattcattgcatacaatattccatcttatataggagtcaccttttcctgaaaatactaagaaagaaaacaacaagcaactagcgttccttaggcagatgagaatgcttcatgactagaataaatttaaaacccaagcacacatttttaaaaaatggctccctctttccaactctcaggggtaaaaattgatggattgaattttctctcattttagtttttcctcctgcacattttcttaaacctttggtgcctggcatagcttatcttcaagcaagcgtctgcagacaagacaaatgaacaaaaaggagcaaatataaattggaaaacttgggaatagccttttcttatatacaagatcttgggcctgtcagttaatactgcagacttgtagggtggtcatgatttctgctaggagaactgcattgagtttgaatgatggaattaaatttagcgatatttttctctgttctgttaaaaacacaataccttccaggttctctggagctggcttcacagtccctagccagaacacagatggtctctaagattccctccggttccatcatcctgtgttcctaaatgtaaatgaatgtgctttcatgaagatgaatgcaataaatacaattgcattcttcagtacgcaaaacactttcacctccctcaactaatgttatccttacaaactgaacttccacgttacagagaccagaaaggtaatggacatcccaaaggttgggctggagttgatactataggcccacaaatcctttttgaggaaaaaagggtcaagtaagtagacatcttcggtctaaggcttctgggtcacttcattaccaccttgatagcaatgtgcaggaagcgaaggctttgaaatcaaccacagtctcttaccagctgtgagacttgggcaaataacttaacactcagagtctcagctctcctaactgttaaaatgaggcttgcaattccaaatctaataagctggtttaggattaactgagatgctaaatgcatatcagagtgtctgatacagagtaagcacattttttaagagacaagacctcattctgtcacccagactggagtgcagtggtgcagtcatatagcttactgcagccttgaacatctggcctcaagtgatcttcctgtcccagactcctgagtaactgggactataggtgcatatcaccacgcctggataattttgtttttaaaattatttgtagagattgggcctcactatattgcccaggttggtcttgaactcctggcctcaagtaatccctcactcagcctcccaaaacactgggaatgcgggtgtgagccaccacacctagtcagagaatgagtacatttttattgtgccaagaaaacatttttaaaaagagatggagtctccctacgttgcttaggatagactcaaaccccttggctcaaggggtcctcccacttcagcctcttgagtatctgagactagagacatgccaccatgccgtgctattgacaaaagaaaaaaaaacaagtaacaaaaatcttaaaccattagtcatatagtcatagcaaatccagattttctgctcagcatggacagtggaatccaataatccaatgagaatcagagtcactagccaaattcctccctcccagatctatcctgtccatgacttcagaggaaggccacatcatatggctcagaactccgtgggagtagagccacctataccttacaatggagttcttcattcaataccgttagtggatgctgtatccagggccaggcactggggacacagtgataaaatgaacactgtccctttttaaaacaggacactgtttagtggaagagggaggtaaagataatgaaaacagagtgtgctaaatgcttaggtagagagcaaagcatcataatactgagaacctgtcttctaactccttttgcaaggagaaaggctatgagaaatttccagagaaagtaccaattgctcagagccttaaataaaggatgtggaacttgggaaagatgacagaaagagtattatgagcaagagaaaggggcaagggttatacagaaagttccacacactttggttcccctggagcttaaagtgagagacaattttgttaccaagagaattcatcttcaagctaggaaagagagcctgctgttttctacccaatcttacttctcttccaagaccctcatttaaaaattccacttcttttcatagccctactgcctggccccactctcctttctgacatctgttactgttatcccagataccctgggtgcagcgagagcagagtgtagggatctggacagacttgggcttgagccttcattatatctcgaactcattatgtgactttgggtaagttccttaaattctttaagcctcagttccttctctgaaaaatgttgagcataaatctccctcaagaattgtggggtttcttcttttggtagtgctaaaattcaatgtaataatataagcaaagtgcttaacacactacccaaactggattaagcaatcaactaattaaagcatttattatcattattgttatccggcttaacctagataagcctgcggagggtcttgcacagagtcaaagctcaataaatactaagttctccatttccctttggggtaaccgatcgcctttgactcactgttgtcctttcatgttcaaattttactatccttcctggatcctgtaacattcagggttttcatctccattctacttcatccagtcccattcatggttacaccttggatcttgccataatttggaatctggatgtggctgcaacattaattccaaagacacagcttctgctcatggtcttctgtctgctctcatatcttgctctttcatgcttatcaagtttctgctttgacctccaaaagatcaccaggtcctgaatttaggcatattgtgtcaaacacttgggaaaatataaaactgttgctgacagatttatattaaactgttacatgccagaaaaaattgtttttccagcagctagttggaagaaaggggagaaccccactctcttacttttaattccttcctttcttgaaattttacttcctccaagtttcacttcttccctaagaacttgaagttctcaggtgatttgttaccaggattcatctaaatgtaccattcctattttccaagtctatctcagtattcaatcacaataacactaataacatttactgtttatggagtgtttactacatgacagttattagtttaaggtaaatacagccatcattttatgtaatcctcataatgtccatggtacatggaagtatctgcctcatttttttacccccaatttcaaatccacattgttgctgcctcagtatagatagagtacacttcattgccccttgacttgggcttggctgtgtgacttgctttggtgaatggtatgtgtagggaactcaggatgtgctagttatgagcctgggcttcaagaagcatcacatatttctactcccacacttgcatctgacaccaccaagaggaaggcttgtcgcagctagtgtgctagatgaagaaggaagaatgactcagggtagactcacagctctgcagcatggagcagagtcaccttaactcctacagcctgggtccttgaccctagcaaatctgtaaatgatgagcaatgcctgtgagatgagaacaacacttcattctatcctcctttctatcctcagaactaatcaatatttattatttcaggacactaagattctatagttgtttgttacgtagcattgttgtggcagtgactgactgaaacacaacccttcaagatacatatcattatctctatcttataaatgcgtgagtgaggcaaacagagcttaattaatttttcaagggtcatacacaaccttagaatagcagaactgcataaatatcctcaaatactactttagggcttattttgcagtgggaacaataaacatgatttaataaattgacttccatacagaagagggtgaaataaatggtcctcctcacagccacctttcctttagaccacattagtgataattgtgaggatgatccaagaattgacaatcacctgaaactagaggtatccctcgtcagtggcattagagactgttaacacatccattcacagtttttagagttgagctatgcttgccgaatgaatgaacacatgtttccaggcatgtatgaccaggcactcaatgaagggtataaaaatatgcattgtgacaagagtatattacttacccataatatggctgggaatggggatgaggagagagcagaatgtggaatctgtataaattctcactacttcaactgtcagattttccacccatcttctttgaaactaaggcaaatcttcccagtgcaatagggtggttataaaattaaacatatgtaagtcaactataacgaatggcagggatgttagagcaaaattaatgcagccacattataaatatgtcctatttctcaatattaaactcttaaaaatagactggctaaatatatagacaataatggattgaggctaagttggcgttactatgaggcttgggattttccatttaatggcttataatttccatttcccatttctacatgacagtaagagcaggctggcttcattattcatgattacatgccgtcaccatcaacaaaaacacaagcaggaagctagagagtaacatttggggtgtagcagaggatcctgaattggaaactcagcagatctggaagcagaagaatggcactcaagttccatgttagttgctgtgtgactttggacacttcaccaagcctctctcagcctcaggaaattaaaactactgtgacatgtatcttaaagcatttggtaagctaggtcattataaaagtttgcaatattatcacttcatttttactagtaaaccctagttacaaattctgcttaacacatccttaattaaacagtatacatacaaaaggatgagataaaacaaatggttaaaacatgtgaaaaattattttattattatatacatcaaggtccaaatcctggttctgcctgttagcatctgcttacccttgagtacaatgacattgatgttctgagcctctcagttgtcctttgtttacttaatggggataaagatatatataataaggatttaaataagaaaactgtaatatcattcactcattgtgtgtttagtgtttactctacaccaggcaccattacctcatatgccactcaccacaagcctaggaagtgagtgacattatggagagagcccatagcttgtctgacttccatgatcttaaccactctgaaatacaggaagaggagcaaaagaagagtgtggagggaacagagaagagatcaaactgtggagtgctggactgtcccaagcatgtatggaggctgctgtatagatatggggtcccatatgcatcccagaaattgtttctatcccatggtagataatcctgaattgtcttcttcttttccttgttttggccctggttaaaactggctcagctaaatattatagataactcctttcttctctatccccttcccaaacagcagccaaaaaactgagctaaggcagtagagaggacaggaaatcatgtcttcagcagagcagaacaaattccttctctgatgttttttggtgaaataatagagatccatcctagggagccatttgcacagggagcctgcatgtacgggtggacgggtcttgaagaatgctcttatattgctaatgtgcacaatgaggtagagaaatgtgataaaaagaaagagacagagagagagagacagagacagagacagagaggctgtgatagaacctcaaaaccaagcccctctctgtgcaacacaggagactctgataacctcagaaggaagctcacactccaggcactgttctgataagggttacagactatcaagtgctatctctcttctctgagtatcctcctcctcttccttatcctttatctgtcacctatggatttaaagctccagacattggacctgaattagaggtaggtttccaagcagacttttttgcagtccacaccaataatgtagattttataaacacattcaactggacatttttccttctctcctaacttttcattcaattatctgggcatcagagagatcaatatgagttaacagtaaggtgaccactaaagtctagaaccaagaagagcacagctttactcttcattgctcagaccatacctaggagtgtgttgacagatgagtgttacattaagcatattattaacagagcagagtaggtccagatatgagaagctagtctgacatggaagattgtaatggtatcatgaggaactacaagactctaagggagtagaagttagctgccttcaattaaatgaagggctatagtactagcaccacttctaatattaatgtttaacatgtgtattgctatagctgcaccccaggctccacgatgcatgcattatgtatgttataattacaagaactagtatcttttgagtgcttacactgggccagacatctgctaaagggttttgaagttataatttcatgacattctctatgatgctgcaaaacaaacactatttataactctctttaacagatgggaaaactgatcctgagagagattaaggctcttgactaacacagggtttctcaactttggcactattgacatttgaagctggctaattctttgctgtggaaactgtctgatgcattgtaaggtgtttagcagtattcctggcctctatccattagactctagcagccctctccccaagctgtgacaatgaagagtgtctctagatactgccagatgtccattcaggttgtgaaccaatggactaaggtaacaactattattttatgaatctacatctagagattcctaactaaggaaagaagaccatgaagaggtgttaactgggtgcaagccggcagtgacatcactttgcaaaaatgaaaacaaaaaacccagaagagattaaagcatttgataaacgtgaactaaaaggcaggtcagaccactgacaatgcttcaagtccattatcctgtgaatttaaaacttgaggttatttttattctgttttgcagtaactgtggtttagtagttgtagaggaagatgaaaatcttaatttgaaatgtcttctccttagcagaagcctgaagaaattcaccttgcctcaacatgtatgaggttaggaaggtgccactcccaactccatttattcactcctccagcacatacacacagacatacagacatacaccctcttgtccatgcctctgggctcaaaaacaattgatctgattcgttatctagctctccgcagaagaaagctgagatacaatagcaagtcatcagctgtgcagcaaattggcaagtttccactggtttgtaataagttaatgatgcccaagaaaggaagacatagacaggagggaagcccacagcctcccacctgtctcttttcatggccagaacatctatcccctaagctgtatttgaacacagaggagggaagcagaaaggagacatgcacatctctagcaattagagactggaaggaaaaaagacacatggatccaagttagcaggaagcctggtggaagccaatcatccaggtggcatttcagagtcagtcctcaaaagagcctcatgcaaggaattataccaagatgaagttaaattaaagctggactgagttgggctggacatcaaaatgaattcttcaattaacttatatgactcaggcactgaaataaaaatgaaaagggggagaatatggacttccatatccagaaagccaagtcagatctatctgtctgggtgactttagccttcatctgcaaaacagggactgaagcaacacttggatgttgagtatggtatatcaaagaagaatgaaaggttttcttaggtggcatacataaagatgcagaagtacaaactcattttcagttcagaaactgatgagttatttagtatgactagagttcagttttcctatagggttggtgctatagatgagaaggagcgaatgaccccatcgtgatgaggcttaaatgccaagctacacatttgaagtttagtctgtataacatatataagaagactttcatcagaagagtgacactgtcagagatatacttaagaaagatcagtgtaactataactatggaacaaggatcttagggaaaagaatgcatcatgataataatgatgaaaagagctgcaatttattaagccacatggcatgtattggcatttagcacagtgccagtaactgtgctaggcattttacctgaatttcccaatttaatacaacagtgtaaggtaaatacttatacaaaataaaaaaatagaaaaaattaagcctataattaaagttgtgctcaaagtctcaatagtaattatacgtgtagtcagggtactaacccagttccactgctagtgactatgcatttattcaaataaactgtgcaagtccagatacaaagatacagattttgactatagcagtatcaaaggaaatagaaaacaggacatgcatttagaaaagatatgtttaggggttagaatgggcaagaatgaaaggacttagatatgaattggaggagacaggaagaagtcaagactgcattctaattttcccatttggaatgctatataagtatgatttgagagttaactatatcccgatatatccagaagttggttggatgttcccctttgcaattacagacggatgacttgtcattgatatgttccttactatgatcaacttgtctacagaactaaatcaaaactttcaccacagaaaattttaaaatgtcatggcatgaataaatttccacatttccctatcagtatcagtgagtgcatggcagaagggcattgggtgaggccacgtcctagactctgggattttgtcaagactagaagattcaggcagatagccaggaagaacactggtgaaatgtgcaggggggcttgtggaagactgaacttgaaactttggtaaacaaaatttatgcaaatatttacactgtcctattaaatttgcttatcatgaatctctctgtggctttgacctaccaggtaagtcaaatccttgtggtctcactgcttttctgggacaacagacattgcactcactctgatcttcactgcttgcccaccttcagcaaagtctccatccctttctgcatccttgtcctcttggatgtacctggccctccctacctcatcctctctccagtcacagtcctcattcacttccaagctaattgtctccactggtgtatgcaaacgaaccatttatgggaaatgccgtggaatgttaatttcatttgaaattgggtaattgcaaaaagtgcttccacttttttattatatagaatgaataagtattgtattaatagtgccatttccaattatgaccactatcgcaggcctgtcgtctgctaactgtgggttatttttcatggagcatttttctgaacagtttttttaaaatccccccttctttgcaccattgtaattaagataatgcagaataattataaaaacattggaagctcaaatgccagcatagactatccaactagtgctgcatgcttattctaatttctcaagcgaaaaagaaaaagtgttggagtctactgaggaaggcggatgaaggttgatgaagtcagcaagaaattggccagaacagctcagaaaacctggccagagcccatgtgtggggagctgagcttgattagatatttctagaaagcaaccaggaagtgtgctaaagatttttgggtattgaaaaaatatttattgagcatcaattcattattgagttgtgtgccaccatgcacagctaaattttgtgcatctactgtatatcaggtgcttgatatagatgatctgatttccccatcaagacaacttcatgagatttgttttttattaccatttgacagataaagaaactaaaagtctaagacgttaaggaagttggacaacttgaaaaaccagaatttgcaagctgagatttaatcctcgattctactcttagctagttatggcaattagctagttattgctattaagaaccactccaaacaagattgtattcatcaatgtgtttgtgggtaaagtggaggtcagattagtctggctaggctcagttttgctccaagctgcagattgagttcaggtttacttcatgtctcacatcttctttaagccaatggactatgtgggacatattcccacaaagatatgaaagtcacaagaaggatactccactatgaaaatgcatttaaggccttcgtttgtgtcctacctacttacatcttaatggtcaaagtaagccagatggccaagctcaacatcaataggatgggaaagtgtaccctgcccacagtggccaatggggagtgaatatttgccgaatggtaatccaagctattaaataacatacctataaaatgtttcaagtttctacaacaccatgaaaatcacacaggatctaagttcctagggggcaggggtccagtcaaagggaggcatctgtggtgacacagaagtggtatagtattatgtgacctggagcaaggtagttcctcattgtcacttttcccatccatataaatcacaataacacaggaccaatctccctaaaaaggccactggagggtaatcacaataacacaggacccatctccctaaaaaggccactagagggtgactatgatgcctataacaagttttaagaaatggaatgcttctttgtatgctcatgtcctatcaacttgttctgctttattcttcattaaacatattatatatttatttttattatttttcctcccttgagtttccaaatgtatgctaaatgaatataatgactttctatttcattaacttttatattgcccatacctaaaacactgactagaatgtagtaggcactcagtaagatttcttaataagtgaaatgcaaggtgtgcaaaccccagcttataaatatcctgtatatgtaacacaaagaatgatacaaagaactgaacttgcactaactaggtactgtcttgactctgaagaaaggacaaggttttgtgagagacacagtgggatgatgaagatcataatgggaagagatggtgatttcatgttggtactaatgataatggaaattataaagtacacacacacacacacgcacacatacacacacacaaatggtccctcaacttgaaatcaaaagtagtgatgacattttctgagctgtgaaattttggcagatcttttaaccactgcaattctcaagggatcttatctatgtaattggtttaataatatagactgccagaatatctcaagtctctgagataacatgttaaagcatctgacacaaaatatatgtagctaccaggatgatgatgatggtggtggtggggacagtggtagtggtaatgatgattagcattctcttaccatgttgtttttcttgggaaaggaacacaaaaataactcttgtgaaagtaaacagaattaaaaccacacaacagatacaacaaagggctgggggttaaaagtgagagaaagcgcttccattgaggagaactggagcagctttatgaaagaaaaggcgttttttttcttttttcttttttgcaagacagggtctcactctgtcacccaggctagagtgcagtggtgcaatctcggctcactgcaacctatgcttcctgggttcaagcaattctcctgcctcagcctccctagtaactgggattacagttgtgtgccaccatgcacagctaatttctgttttttaaatagagacggggttttgccatgttggccaggctggtcttgaattcctgacttcaagtgatctgcccaccttggcctctcaaaatactgggattacaggcatgaacccctgtgcaggctgaagaggaggcttctctaaagactcttaaagactatgtaagattcatatatggggagatggaagagcaaaattctggcaaggggaaacaaagcaagaaaatctacagagagagaaaagggcacaggtaacagttacaactgtccaaacaattttcacacatttttctttttctttttttttagaatctttagatttatcttagcaattccagagttactatattagttgatttctataatagccatgtatgacatataggacagtttatatcaccactttatagataaagaaacagagactcaaagagagtgcataatttaactttgtagctgggtgaaaaatggaaatttcagctcagaccttgaagtgacacatatcagaaatcaaaatgagttggaggtagatcacccaatagatcatgagaaaagcagatagataagaaccagttagtaaactattaaacttttctatcctatcaggggaagaacaggtaacttttgaagagatgatttatagaggattttttgggaaacagcattattgtgagcctcacctcctccttcctggaggtgagtgcctgctctcttggcaagtgtagagagaagggttctctcaggactactcatggagcttcacttgtggtccctggccagtgatctggtgtccaggtttacaccagggaaatgtatggaatgagatgggctggccagctgctctggtgagagcaaagcagaagtatctgtgtaggcattcgcttatatgcccagagcattctccaaggcccaggtaggatgacaaaccagagaaaacaagcatgtggttaaaatacagaagagctactaaaaacaaggactctaagccagactgtatgagctccaatcctggctcctccacataccagctgtgagatcttgggcaagttctttaagctttcctagcctcggtttctgtatctgtaaaatctgtaaaattcagataataattgtactgttgtacaaagggtgttgtgaggattaaatgagtaaatataggtaaatcattcattacattgtaaggcctatgcatatgttggttagttatcaaaatcatcctaaattccgtggaataaggatgcctggaggggtgaacagatctcattagagagaagccagagaaattattggattcatagaatgagtgaatgaacacatgggaacatgcatgcatccaaacacattaaagaaacctcagaagagagatgggtaggaacagggactggtttctaaggagaccaggaaaatgctcccagacaaagatctttaatgtctaccgggatcactgaagttgaagtcaggttatgaaaatgccagtcaacctttcctgctcctcatacctttctctgccaggctccatctacacggaagccccagaggggttacaaacagtagctaaaaagtaggggaggaggtaagtgacaaagagaaagcaagcaagtttcacctgccttcctcagctcccaagacagctacaactccagttaggggagcagaagggaggcccacctttgagtggagactgaaaggttggcaaatatatggcattgaacatctctgaattgagactgtattttgtacattcagtaaatgctggactttgtattacctaatgctgatcagaaaagtcacaggactgccaagttttcatccaggggcagaggaaaaactaatgccataatactactcaacaagtataaagggtgataggaaataagagtaaagatgctttgtgactgcatcacatgggccattcctggacagcatactgggttacaactttctcatactatttttgtaatacttactattttattacatttatacaactttttttcactctagccagggcttttaaataaatcatcacaaccaatccagataaaaattacttagcatggaagtggcagaatttgacttgagtctacatctcccaactcaggaaccattctccctaccatgagacaatcgatatatacaatttatgagtctaaataatgcatttttccctttagttcacacttggattgaccattaataagtcttttttcccccaacgggttaagtacttttgctatatattcccattttattgtagacttccactcttgtaacacttttcataggtgcaatgatgtgtgattgctaccaattgaaaatgacttccacacaggcaaaggccatatttgtataacttatgactctccagcgaccagcatagtgcctggcatatagcaggaactcactatatgtctgataaatgaatgaataaatggattaatcatcattttcaccatcagtttcaaagcactgatctttttgagttcagtgattttttgattgataaacaattggtttcatgcataaagatctgtcttgaaatatattttcaattaaaacattacatccactgggttttaatatcagttttagaagcatccacttttagaggtatgtgaaaccttcaaaatcatgattttcatatggggaaactgagtcccagaaattgagaacaacattgagacaaggtcaggatgagaatgcaggcagaaatctgcccctaagttcagcactctttctgtgacttccaactggctgaagaaccctttggccctgtatagctgattgtttttatggattcatactccagggtatcacctggtgagactgtcattgggtgtaaatgaaaagtgaacagaagcctggaggaagcttccactctggcataaataaaggagagcagaatcctagcctaatgttgtatgaagtttggggaaagatcaatagctattaaatcaaaacagcctcctggtctccttaaacccctgccccccaatcccctccaggtagccagcaggctctgaagtgtgttattcatgggtagatttgaggttgtgaatgaagcatccttatgaaacatgggcctgagctgaagcagcgaaggttcctcagggcataaagatagggatctctgacttctccatgggatgtcaggctttggtgaaattttcctggcacatgcctgacccctgctgctgtgaactttgctgggagcctacccatccctcactgggcatctgattctcagcaggtgttcaggaggacaaatggtgatagccaagttgaatgaatgccctctccatgtgggcactgtactaagtgcatggatggatcatctttcacttctcccaataacctgatgagataaataacttcttattatggccattttacagttgaaaaacctgcagctctagaaggctaccacacttcccccaagaagatatggctggtgtagggtagatgaagtatttgaacatacagtctgacttcagagcccacactgacaaccactgagctttgtaactcctacagctcacatggtggcaatatttgtttggggaggtcatggcctctcaacacacctccctgatgctgccctgcctattccatccctctcccgccatttgcatttacactgacgtagagtgtatgagtcttttgacgaacacttacaacatgccttgtatgattttagttcattacagtcagtacttttcttcagtctctgcacagtaggtattgttacatctgccttacagaagagcaaatggaggctcaagaaggtgaaatatcttcctgaaggtcatctgggcagcaaggggcaaggcttagattctgagttcaagggctgggctcctttcaaagtgcttgagtggagccctgcctgactgacccagattgaagtgattcccatacctctaaactgcggctcctcttttcctgatactgtcttcatggaatgcagaactgcgcagcacggaagtccaacagttaactcatgataatggatagttacttgtgtcatgagactttggggtcctgagagtgagggccacctgtgttcactctgcattccacacaaacccttagcccagcacccagcacactatagatatttaaaattccagtggcaaaatgtcatcctctttctccataatttcagctgtgagttacggagcaagtcacttcatgcttcttaaactctactgtccatgtctatcaaaatgaaataataccacctccctataaaattggttgtatggtgaaatgaggaactaaatgtaaaacatctattattaaatagaatgccttatgcaaagtaagtgtctagtaaaataaaacaaatacattaaaaagccgttatcataggaacatctgcacctgaagcaacccattgattatctgaggtttccaaacctgtgaaacataatcatggagtaaaaagtatctctggaaagaaatagaaaacaaataatcctgcttattagtaattatataagacaggtcttaacttagttaactggttttatggtacacagacattgaggcttatcaataaaattaataataatgatgctgatgataataccaagcatctgcataacattgtataattctagaatgttctcatttatagtaacagtggaagggaaaaagagacacaaaaaacaaatatgcaggtatggagtctgaagggtcaggtcacaaaggagagcccagcaaatcctccggtatggctcccctgtctctctcctcttcagtctcatcctttctaactcatcctttccgttgtagtcaatttgatctgccaaaaattcaaatagaatcttataatttatctgtctaaagactcttcatgactttccactgcttttagaacaaagtcaaatgcttgcacatggcttgcaaggaaggccctttacagcctggtctataacagcctcttcatcacttgctgctatctattcctttgtgaagcaaaacaagccaaacctaacgtctcacagctccttcacatataattttctctttcacttcaaatacttcctattcctcatctcccctagctaagagctacacatccttcagatctctgattagctctctgctactcagataaatctttcctgaccctctgcagtaagtggatccctttgttaaatggcagcatctaattattccctcataacatactcttattattcagtatcttcttccccatagactgcaaactcccctaggatcaaataagatattccatatttaagaacctggcatgacaccaggaatgcaacatgatgtttgacttctttcctctcttagactcagtttcctcaaagggataattatgttgacaacatccattcttcctgccatactgggctggtatgaaaataaaaggacatataaaagagtaatgttaaaattcccaattgctattcatttagcagtgatatttatcttattttgtaatttagaaagatgatctacaaaagcaaaaccaaagtaaaccaaaagataattcgaaattttgataggtaagattaggaaaaataccatcaatgggatctgaaaaaaacctcaaaatacttcgagcgaaacacacgatctatattgatttgtctataatgctctatctctgtcatctgtcatcagtttatctatctatctacctatcatccaatgttgatcacaccaaaaccttttttttcaaaacatttccttaattgctaaatttttgtgacttcaaagaaaagtgaaatccatataattctgagtcatctacagttaaatcattaaaacattactttttagtggtcaggagattttgagatgatttgaatacatttcctaaaaccattatcttcttctctcttcattttaaccacccttcctaaacacaatgccacactaaggaaatgagcaaaatcagaatacaacaaacgctcaaaatactgtgggtgcatgaactcataaaacatgaaataactttctgggagttggaaatattggctgaaaacatcattttctcttttgaacctgaatgtgatggacaaaaccaactgaatcagggaaaaaaaatatctatttagtacattatcaagcatctatgataaaccaggctctgaacaaggaagacattgactctaatctcaagaacttatgttacagaagtagagagagacatcaagtaatttcatgaatgccatgcactgcactggactctctgtgaacatgttacaggtaaatctgatgttatctgggatgtcagcaaacgttttcctgagtaaagaatatccaaggtaacatatggcttgacttttagcctaagagcaatgttttatagccatggaggtgataagaactgatctaaattttagagaggttatcaaggtggctttgaagagaaagaaacccagggcagtgggcagtatgatggggtagagaccatttacagaggccactaaccaagtcagcttctttgagactcagtttttttcacctctaaaatggaggttacaatccttctttctccattgcagagttgcctggaggagataagaggatagtgggaggaactaagaagctggtgggaggagctaaaacaataggagggagagctctaaggatgatggatgagctaagagaatgatgagaggaactacgaagatatgggaagaaccaagaaaattatgagtgtgtgaatgcttcacaacctgaaaatgctgtgcatgttaaattaatgggaataaaatgtactttatcagtgtcttcacttccacaaggacatggatcctgtgatgacctacggtcacacacctttgatgaagtatgagagtttttaacttacatttggaggtgagggttctgtaccctgagatcctaatgaaagccagagcgttgatgaagtatgggagtttttaacttatatttggaggtgagagttctgtacccttgagatcctaatgaaaaccagagcctttatttttttagaaaactgcttagtgtagaacaatgcctataatcctcaccgatttccagacacatatgccctgtaatcaatccagggacctcatgttagaaatttcaggtttagtataaagccttcagtcattacagcagttcttttctaacttgtcagattataactcatagtaaaaaatacgcatttaatatttctagccaactgaacaaaagttgcatgaagcagtaatatttcctattctctcctgctatattgttctctatttaatgttattgcagtttgtttttttcatgattttaaatgctggctaagacttataaattgaacctaacttgtagtgcgaaaaacaatgtttaaagaatgacaagcctatttttcagttttgcctctatctgttaattgcaggggcaatcttggacaatacacatctcctctgagcctcaatatcctcagctgtaacatggggataatagcgcttacctgaaaaactgagacaattaaggtaatactataagaaatcactacgcagaaatcatggcacagactaggtgttcaataaactgtagtgattataaatagaggttgctaatgggggaattagagcatagctaaatctctcttgcctgagggaaaataaaaaggaagaagaaaaagaaaaaaaaaaaatctcattcattttccacccagggggtctttctgtcttccaaatgtagctatttgctgtggggagaggaactcagtccaaatgcctctgtttgctgtgacaggatttataaataagtaaaacgctttatcaaacatttatagttgtgtgtgaatccgaaaagaaaaaagaaaggaagaggcacgtgggcttggggtttatttatagtgactctctgcttttccctttcctgccacaattgcacagcttagctttcatttgcttatgattgttcttggataaacttcacttccaaacagagggtattaattattaaaacacagaccagataaaacagcccattctgttcccccaaacaatgacaggatgatgcggcagaaggaagccactagaaaaaagggcagagaattgccaacacacgctttcaaacagagtcaatctttggcaaaactcatgttaacgaacattctgtgggcgcctactatgtgcagcttggaggctacgtcagacatggtggggtggggcagggggctggtgtggggagggaaggtttccatgatgaattagagacagcttttaatttatatcccagtgaagggagggagttcccaacaaaagcaaggaggagatatgtaaacaccaaactctaagagaaagtgcctctgaacaaagtgctttgggaacggcataacagagtacttcctcttaggaggcatcctggtcttggaaggagagcagctctgggatctggctatcttgggtttgaatccctgttccagcacatcctacctctgtgatcatgagcatggtcatctcttcatgacacaggtgtggttatacctcttggggaaggtcattgtgaggactaaatatgaaaattcatgtgaactgctagacacactgcatataatcattaaatagcaagtatttaatagtaataagattcagtttggcacatagtaggcactaaataaatctcatacttcctttcctttgcttgagagtcttaattcaatttcaattgcatccaccttccagccactccaaatacaatgtgcttgtatatcattgacatcctctgtttcccattgtgtgtctcatccttatatgacctcagttgcaatcttcttcagaacttatctattaattaatgtattcatccattaatattgattgagcacctgctaggtgacaacactgatgaaggcactagggattcaatgaagaaggaagacaaaatttctacctgcatgaagcatgctttctaatggggcagagagcaataactgcatcaataagtaaaatataagctttgtcagatgatgctaaacactaaagagaaagatcaggcaggaaaaagaagcatgaattgctggagtgagtgctatttaaaatgagaaggcctggggagaccttatggggaaagtaacatgtatgcagagactgaagaggtcacaagcagccaggtaggtatttaagagaagagtgttccaacagagaagacagcagatgaaacaccttgaggcagaagcaggcttggccgtatcccatttctcattttagtcttcagaaaagaggcagggagcagagtgatttgattttgcaaaacaactctgcttttcccacatactaatataagcaagccataccttgccaggtatcgtatccattgtccacattaggttccacaaatacatgtaccaagagacagatgcctagatgtgttctgccccttctttatgtgacagggcagcatggttctaggctgggctcaaagttgctgggaaccgcatcattaccaccaaccatgccatcctgagatcctgagctctccaaggatgagagctctcagcgacatcccatagaatttggactaacttctcaggatgctagcactttgcaggaggaatttaaataaaactagaaacaaacaaaggcaaaagaaaaaaagaaaagaaaagaaaaaatattacgaggaagcacagaatagaaatattctcctttgcccaactaactgaaacatttgcaggtatgcaatgcctcacagagtacaggtacagggttagtgtcatgtccaaagagtaaaggctccagagaaagccctgcctgcatgggttcctggcctagctgtgtgactgcagaagggttgtttaacctctctgtggatgaatctataaaatgaaactaataacagtacttttctcaaagcactggtgttaatgtaaaatgagttatttgagtaaatgtctaacctagtacctggtatggagtaatctatttgatatggtttggctgtgtccccacccaaatctcatattgaatcataatccccatgtgtcaatggagggacctggtgggaagtgactggatcatgggatcggtttcccccatgctgttctcgtgatagtgagtgagatctcatgagatctgatggttttacaaggggctcttccccctttgctccttcttctctctcctactgccttgtgaagaaggtgcttgctccttcttcaccttcggccataattgtaagtttaagtttcctgaggcctccccagccatgtggaactgtgactcaattaaacctctttcctttataaattaccgagccttgggcactttttatagcagtgtgaaaatgaactaatacactatctaaacattagtgtttaaaagaatgactatatacattttagtaaattcatataaggggacactatatcgtaattaaaaaaaattatcaatacttgcaacaacatggatgaatctcaaacatgatgttttgagtgaaaagaaggcagacacaaaataacgcatctgtaggatcgcatatctatgaagcacaggaaatatcaatttatgatctaagaagccagagtactgtttactttttatgggtggacatggtctaggaaggtacaaaaaaatgaaacataaggggtgctagaattattctatcataaggctgcccagcagaactttctgttacaatgacattgttcatattctatgttgtgtgatacagtaggtactgtagaataggcatatgctgccaccgggtccttagaatgtggcttgtttgaccaaagaactggacttttaagtttaattaattttcattaattttaatttcaaaggccactgtatcgggaggcacagatctatatgttggtctgggtggtggttacttgagtataggcatacataaagaaaaccaagaatacatttaagtctagtgcaatttatatgcactgcatatactttattgagtgttaccttttaaaaattagctatgactattaatctacatgcatcacctcatacattcctcacacacttgaggtaatatagagaggaaagtccccattgtccccatttgtgaactggttcagctgtggctcagagaggtggatgtgatctgggaatggtcacgtggcttgtgaatcccagagtgggtaacatttctatccaagttttctctcacgaatgggaaaaaggcagtgtaaaataacctgctgagatgatttcattcaacaattcattcatcaagggcatactgtttgagtgccagatgctgttttagatgcttaaaagaaaacactggacaaaagggaaagttctggtttccatggagctttcattaggaatctttgctcatcccacactttggccaccccttgggtcccttacctgaagtaacttgaccatgggccaaattgtgtgaaatcagactcaactaagcattcgcagttacctatgctctagatttgactcctgcttcctactggaactacctaggcttcttgttcttctagacttagattttctcatttataaaataaggaaagggataaaagaagacatacaggaaaaatactaactagcataaaggcaaacagcatgtatggcaataaagattcttattacttaattgtaaaacaccaattacttacaaaaaaataaataaaaccacagcaatccaaaacttcattcacttagcaatctggccccaaaacaagaaagcaaaacctgttagaaacaaatgaaattcaccaatcttgagtttgaatgaaagatttttgcacatctgtcttaaaagcaaccgtaactacaaaaaaatcaagcaggcaaaaaattagatatagaaatttggtcaataaaagtaacaggtagtatctaatggttacacatgaaatgttttgtccattaattagaaaatgtacagtgtttctcaaacacacagaaactatttataaaaagtagccatgctccagggtacaaagtaaacctaacaaatagccaagaatttaatagtacccagaacatattatttaataaaatacagtaaaattagtgttaataacaaaaagttttctaaacatatgcctggaaatgtaaataaaaatgtccaaataataaacaaaataataaaaaaatagaattaaacaacatgcacgctacatagcaaaacttgaggtctagagataaagaaacacttcagagaaagttataccatttgatgcaaatattgttaaaaagaaagattgaaaaataatcatctaggcatttaagaagttaaaaaagaatggcaataataataaagaatgtagaataaagaaaatatgataaaaattaatgatatagaagagaaataatatagaatatcaacaaatcatgagcaaagtttttttaaaccttttatcactacgtcttgctctctctcctttactcttactaaaaaacagaaaccaaaaccaagaacaaaaaaaacactaataaaatagatataatataacaccaacaagattgacagacaaggcataaaaacaaaatctctggaattaaaatgaggacagaattatagatgtggtagagacttgggatatgtatagctagctagctaactagatagatagatagatagatagatagatagatagatagatagatagattagatagacacacaaccatgaatacacatacttatttatcacaggtatacaaacacacatgcatatataatactatctgctaaatatttaacaaataatattaaacaacacaagacaatatgtctataaatgagacaacttagaaaaaataagtgagtctcaggaaaataacaaatactaaaacagagttaagaagaaacagacaactaaaatagccatataaatatttgaaccaatagtcagaaattaccatctaacaaatagacaaacatcaaacaaatagacttaagcataaattctagcaaactttatgagatatacccacttcacataataattacatatacaaatatttatacacaatagcatgacagcacaagaaggaaggctgtgtaaacctcatgttttatgaagctaggataatgttgatattggaacttaacaaagatgttaaaaaacgtaaggatagtttactaatagaaacgacagtaatacactacacaatcaggttaaaagagaagacatcacctcacttgatgctgaaagagtatttaataaattgtaatatccaatcacggcttgaaaaatgattagtatattaggaatagaaggaaaatttgctgtcaaaagtttactaacatttactatttggttatctaacaaaaacctaacactctatcattatgatatattatgacatatagtgatagagctttagttttattttctttaaagtaaagtacaagaaaatggcatgctctgccatcatttttcttcaacactgaatgggaggcccagtctggaagagcattagaacaagataattcaaatacaagatacaaagattcgcaagactattaatggcaaattatgtcattttttccacatgaaaatttaaaaaaaatctagaggctaaaagtaataaaataatcacatcttctggcttcaatcaaagaaaaactgatgttcttatacacaagaaaggaacaattaataaatgtaatacaagtgaaaagatacaatttgcaacagttgcagaaatagtgatgctggtagaaattagatacaactaaaagtctgtgatatatgtatagataaaatgtttagatgtttaactctattcatagccatacaagaaggctcaaataaagaaatatattatttcatggatgagaagtctaagttttgtgaattttgcaagtgagtctgtaaattgaatgtaatcccaatcccagtgacagcaagccttttcataaataagactttatcttaaaattcacacagaagagtaatgagagaaaaatagctaagacatttacagaagaaaatgaatgagggagtcctgccctttctgataccaagatattacaaaaccataataactaaaagtagcatggtactagaacaggagagctcagaaactgacctccagatacacgaggacttgtcctatgacagtggtgtcataaatccatggagtaagaatggactccagatagtgaactaggacaattagctatccatgtgaaaaactaaagcaaacaaagtccatggttaaagactgaaatgtttacaagcaaaatcttaaaaatttagaagaaattataggtgcataactaagacactaggatagtaaaaaattctaaattcctcagttattcacaaaaagtataaactacaaatgaaaaaaacattgtagaattaaaatgaaaatattcaaaattaggaaatgattttcttaacaaaactaaaacataagtcatagattggaagaagatattttcacatgacaaaggcctacttatgtttttaaatatgattattatcaatatttataaggaacatttactaatcaggtaaaaaaaaaaccatcataaaaatatgcaaaagatataatcaggattgaaaaagaaagaaaatttaatataaggaaaaatgtttaacctcattattatctttgacatgcaaattaaataatcattgaagttataatttcatatcttacagaatggcaaaatataataagggttgtcgagaatttgggaaaatgagagattttattcattgctggtggagtgtggtaagataaaaaatttaaaagcacaggacacaggacaatcttagataagattatgataccatatataaagtaaaagtataactatccaaataggttagaaatatcaacctttgtgtagtaagaaacagaatcagtgaagttgattagctatgtgtaatttaacattttaaatgtaaaaaaatccgatgtataccacaaaatatttgtattctcatttgggtggttagaatatatgtaattatatttactttattgcatgataaaagtaatttgtaactaaaaataaagtacattttaggagtattttagaaaagatttaattgaagaaaaaaaaagatagatatgaggatgtaaagatgaagccaagggaaagatcagcgctaaaatttaacttacagtgccaggtacagtggcttacacctctaaaccccacaacttgggaggctgaggtgggaggcttgctcaaggccaggagttcaagaccagcctaagtagcatagcaagacttcatctccaaaaaattgttttaattagctaggcatgatggtgtactcctgtagtcccagctacttgagagactgaggtaggagattgcttgagcctatgagttgcagtgagctatgatcacaccactgcactctagcctgggtgacagaataagaccttgtctctaaaaaataaagaattaatacatacaatgtctggtatatttcctagagtttctgtttcaaattagactctgagcattctagcagacagtacaaacatggaaaacttgttatagtattcagatgtctaaaaagtttaaaataaccatctggccaaagaacagtaatcctgattctggtttttgaggacaatgttcctatttcataacctgtgtgagttattaagtaacagcctcacccagaccctctatgaaattagagtgaactacaatgaggtctaatgataaaaacagtacctgtataggccaaggagtgtctaaacagtttatgctctgtaactaacttaatacttacagctagccttgttttattattatcaccattttatgcataaggaagctgagggacaaatcagttaaataacttgactcagtcctacagctgtgaagtggagaaacctggaacagaatgcattctctccaccgcccggtgttaatgtcatcaaggcaaagtcagcttcacagaaatagtttcatcatctccaagtaagatggtccaggtgtgtctgggaccttagaattgtgtgaccaaagctatagattccctccctcagaaactaaaggtacccaatgttttgcaaatattttcagtgtaaaactcaaacatgggccccacattttaaaaatcctactctagaaaggagtgagcaaattgcatcttctcagtcattgatctatgtatctacctgttcaccatggggcatccttaatttgggaggattgctaatataattaacatagtaggagtgcacaagaactactagttgtgattagagtcatcatttttgttattgttatatgcagcaacctgcgacctgttctctcagcttccatgtgtggcctctaatcctccatgcttcctttagtggtaggtggggccccttcaggaataaatctgaacttgtccatcctgtgcctcatttgttccacactctacaagggcttcacacttagaggagaatcccagctctttaccatcaactccaaggccccgtgtgatcgggccctgtcttaggtctccaatctcaccatctataattctcaccttttcttacccactccatcctattgtcccttgttgttggaatctatctcaaagccttgccttatttcaaatactctcttgttctctgataatctctctgacttagcagtgcttcatccctttcattctttattctctctactccatcttgacccttatctccatccttcatgaatgtttttatgaatgcattcatgtaacaaatgtccatgctctccactagaatgaaagctccacaaggacaagtactggtctattttgagcactgctgtgtccctgctacctgaaaggcacccagcagagaacagacactcaatgagtgtcagtgaacagaaggaaaggagatgggtagggaagtgagttggtttttgtgatgataacttttggatactgttttggacagatctgtgtgcccagttttgaagtagattggtttcaccctcaagcacttaaggaccagagatatatgtccaacaggagaggccagcatagacaaaaatcagcagcaaattccccaacatccctcactaactgctccagggcaggcaatgaaaggacaatggataagcgctcagagggacaaaatcagagggggcaaagttctaggatctctgctggcaggaaaagtgtggaattctggcctgcctatcctggcatagaatcctcaccactcagatccaattagcaagggcacagagaagacgcaggcagggaaatcaaagtgccaagggctggcaaaacatcatctgcaggggagaaggctgggcccagctgggctgcatagagcggcaccagccctaattaagttattagacacacatggctgcagccagggtgttcctgggcccaccaccacagacagtgatggctctgtgggaggctgctgactcaggattccaactgagctccctccagccctctcatagcctgtttttccttctcctttcttcctttattcttttgtaaacatagtagatgaagcggatattccctgagagtagtaacagagataacgtacgtgcacacaatccttaacagtctatatgacacaccattagctcatttcttttatttatgtattcagccaatatgtattgaaggcttactatgtgccaggaaatatcccatgtgctgattacagagtatgtgtgaacagacttagaattccaaccaccagagctttctttctactttgggaaggacaagactatatatgtacacagcatatgtatgtatgcatacatgtatataaatatatataatgatatgctgatatatacatattttcacatatatatgcttatgtggggatatatatgtgtgtgtgtgtatgtatatatatccacatatcttctatatatagtcatcttgagataagtaacccagcttgttgccgtttccatctcccacatggtgaaccagtctccaagaggtaaaatggattacttaggatgacaccatcctaataggagaccccatcatttgtaacactagggaagggattagcaatattcttctggctcctaaaaggaagtctctcttcttcctcttcttggttgcttctccttcttgcacctcttccttgcccccatctcttctcttacctttgataaataaaagtgtaatgtaacgacatgagggcttccctcctatgcttgtttctctcctatgcttgctgtactccaggactgctgggcctaaaggcacaggcagggcctttctgcctgattctgaaagaccccactgcagatctgtcattcagaccccactgcagatctgtcatttcaggctgctgaaagttggtgtttagggacttactttacccccaatcccctggttttgccatttccttacctcagacattaccctccctattcaaggatgtaggatgtaggtgatggatgatgcttctgagatcattggttctcatttgatagatgggaaaactgaggtccatctaagggcatccaattcaaatggcagatctgcagcaaagctttgaataaaatgcagggaggcccatttccagatcagtgctgtatcatctcttggagcatgctagctctgcatctctcttttgattcacagagtagtcttccattcttgatctctctgccttttttctgatctaagtttgtgccaccatgttaaatgatctttctgggaggaagactatctgggcatgacacttctcagttaaaagttttcagtggctccctggggcctcccagataaagtcccaggaccctggtgatctgacccatctcttcctctacagtctgctctttctgttcatgttcctttgttgccagccacttgaaacttctcacagttcctacaatgttctctccctgttgccttgggacctttacacatcccctttcccttgcccctgggttcactgatgagcttatcttcaaattcagctcaaatgtctcctcttgagggaagttctcatccacatcgtcagcacatttgaatgccatttcctctgtgatcctggaatatttgttcatatccatatttcagcacactcacagcaatcatttattgactgcttactatgcaccgagcaccattctaaacaactgatctggagtatctttttttttttttttttggacaggaagtagaatttattggtgagtattaagagggggcagcacagtggaagccctcatgagtgcagggcccgccacttgtccagagggccacgactggggatgtacttgaccccacagccatcagggatgagctgcttctcagccaccatgtcttcaaattcatcaacattgaacttggtgaagccccacttctttgagatgcggatcttctggtggccaggaaacttgaacttggccctgcgcagggcctcaattacatgctccttgttctgcagcttggtgtggatggacatgataacttggccaatgtgaaccctggtcacagtgccctggggctttccaaaggcacctcgcatgcctgtttggagcctgcactggggtagcgcaaggtcagaaacataaacatacatctgaaaggcctgtttccatggtcccttaaagcaacccatacaacaaacaggctgcatacactaccaagaaagctgctgtttgcagccattgcacaatgggcccccatgaggaaaggaacccagttggcttaattggctgcagatgatctggagtatttcaattattcttcacagcaatgtataagctgagaatgctcacataactatttcagagatggggaaactgaagcccagagatgtcaaataacttgccccaggtcaaagagctggtaagtatcagagctaagattgggttctggcaaatgtctcaaatacatttcatactgctgaaattgcctgtttactcaactctcttacacacaaccataaacttgttgaaggtattaatccctctataacctagcacttagcacagtgacttcattctgtacatggagtgtgcactttgtaaatggccaccgagtgaacaatacaagactctcttctattttattttatagcatgctagacaacaggatagcacagtggcaaaaaacacagactctggagtcagacccaggtcccaattgtagctctaccacttcctggtgcttaaagcaggtcctgttttgcctggtctgtttcacagggctaatgatgataccatatggaaaaatcatgtgtattaaataaagaaatccatagcaagtacaaagcatagcacttggatctcaatagacagtagatactcagtgtttgttataatggccgttatcattcactgtgttccttcccttacccctttctttctttcctctctctttcctgctcaccttaagcaagaggcgtcctctcagcaagactcgtttgggattcgcaaaagctgagagggagcatgacttctctggcccactgagcccagtgccctccttccccaccccatgctgccaccttccagctgtgaaatggtgtccctgctcaactgggccccaaagctgtcagggggctgccaatttcacagttcacaaggctgctgttccccccgattaatggggtgccagcagccatgggcagggctctgataccagtcatatgggctctctctcccctgcccacacttcctgaggaaaagagagcaggccagcctcatgcatatttatgtagggagagaaatgattttgtactgcatgccttccaaaaaaaaaaaaataataagatttcacccaagtcccaggcatttccctgagtgaactcagcatgcttcagggaagaaaacgacacagacacagacacacacacacacacacaaacacataccccacagatgcacacatggcataatgaaaaactgaaaacactttatataccactgatctgagcagagtgttctcacaccaaggatgacccaggagacacaggagatattaaaccctagagcatggacagaattattttgaaattaatccagttccaccctatagctctagggaaattagaacagataaggtccaaatgtagccgggcactcaaggcctgccccaccacctcctaatcactgcttttgtctacagcattcctgacctcagactaagctgttctctgttccttgtataagcaatcactttcggtggtatatgccatagtggggcagaagaaaagctttcatcttagggcaatcccagtccttctgttccagttacagaacgtcttaaaagccacttcagcttgcagtgtctcggtgcccccatctctgtgtcctagaataaactgacccaggcttcctcactgtgtttgagccacattggccttctaggccattaagcaagccaagtttttatttcaagagactcttcctcatattgaaacatcacgttgggccccacaaatacagacaattattatttgtcaattaaaaaataaaacagaacttttaaaaagatcactttctctgttcttcagttcatttggttgaacgctacatacccttctaattccagcttaaatcttccttcctcagaaaggccttcttgaacagccaaattgaggtcaagtatcccctttcttctcccagagcatgcagtatgtttccttcctggcagctttgtgttaattaaattagtaattgtgtgataagttggttcaagtctccagtctcaagtctgattttctcattagaggatagcatctctgagggaaagggtcacgccagcactttcactgctctgtcctaatgagtatttggtaaatgaatgaatgaatgaattgctgagtagttgagagaattaaataaagaagcatataaagcacccgatctatctgcagaggacttgctcacaatgcactataataactaacattaattgaccctttttcttgtgataagcactcctttaagcattgtgacatgtattaatcatttagtcttacataaattacatcatttgttcttacaacaactcgggtatccacatccttattgtctccattttagaaacgaggacagtgagaggaaggggagcatttactaatttgcccaaggttatacatagctagtaagtatcagtaaatttcaggagttgacctaggtagcctagtcccagagtccacatttctatccactactctctagaaagatattagttccatcccttcaccttccctctcagatatgttcaggcttagataccttggttgaagactttgtcttccacaaagcctttcctgatttgccagcctcactctattacatctgaaaacctacatccccctttcccacatccatgcatagagagctggggttatgaaatgcagccctgatatcagaatatcctctactgccctccctctggatcttttatgggtggagcaaacctcattttcttgcaatgtgaggacacagtccagaaattgctttctcctctggggtcctacagggagacacccagccctcagaaccaagccaatttaacactcaggagaaccctctcctcctggaatatccatctgacctcctttctgagatagctacaggttaagagccagaagaaggtgtagagacctcacaatccatctgcccacatataaacaggctgaggcccagggttgagaaggacaactcaggcaacagacacgctgaaggcacagcccaggctctctcatttctacctgactgcccaccctctgtagcatactgcctcctctcccctggagcagagccgggggtatagcaagcagacactgccaaggacatagctggagctgtgccgagccaaagcaggcagactgtctgtccatggggcgaggctgcttcctggggtgatgaacagcgccaatcaggcagcacttaacgcaattataatgaagtagatgcatctgttctccgaaggcttcattcaccagggaaatcatgaggaagtgatatctctgtctgccgacctccttgggacactctcagggacagtcctggagccaggaagctgttgacatggactggagactggcctcagccatctcagaatgacagtgactgacaccctttatctcttttgcatcatttctgtaaaaggagctgtcagtagataagagttcgcatgagagaatgtcttcctcttttcctggtttttctaataacctcaccccctacatacactgttggtcatgcctgcaagtcatatggcactgagttccaactcagcttccactgattttaatgtatatccacaccccacagttccactgaagaatgcaggtttagaccagcaaggaagggtccaagctgttcatgatacagatgggaagactgagactcagggaggagatatgactttcccaagattattactatttgtgtcaggtggcctctacaccagattgttcatatattattgcatttcatcctgaaaataacctgagaagagtccaacactattaaaagccagcttcacaggtaaggaatccgagactaaaagaggttagttactctgtccacgattgaggcactgtatgggcacacgattcatacccacatctgcccattccacacccatcttgctactatccatcatcccagaaagccctgacgttatagattggctttggtttatagactagtgtgtctataaacattttgataagctaaaagttgtttaaatcctcttcttttttacatttattcctagtgctatatatgaaaagaatcctgtggtgaattgcttttgtaaaatgaagaatcatttaggaaaataatctgtcacttcctgatttatttctttgctaagctgagcttttcacaaatcagtctcctttgaagcaaggcacaccagccctgctctgggcagatggactccctactattctggacaggatatgatgtttgaggatctgccacattcacagatgcgtgctttagtaaaaaggagctgcagatgcttcataacctagagtgtggcttgctaggtaccccaagactccaccatcctgataaagctgataggaacagagctctatatctgcacagagtcagatagttccagattagcttatggatggtgacgtctcctggtgtggggatctcctcactagggcattcagtattggatatgacaaattctttcatggagtgcttgaaaagaaggcatgagagaagagtcagaggcaggcagagcatgtctcacaaggaatggagatgggctaggcacagaagctgtgaagcagtagaagccatgggcatgcagaggttaggaagcatagagaggttatttccaggtgggagccaaagaggaacagagaaaaagaggccaagattcatgaatttagcagagctacttgaggcagaatcaatgagccaattgctgttatatccaatcaatagtgtatctccatgaagcctgagactgtttctgatcatacctgtccttgtgttcctcaaggaacagaaaggtaaaggaagtacgggaagcagagttattggtgaaaagagagaatttcaaggtcacacagacctagcttcaaatcctgggtctaatacaaaccaggtacatgaccctgagctagttaccagagcctcctctgcttcggtctcctcatctgaaaaagggagtgattagaagtaatgaccatatcaattttttgaaaattttatgcgtaattatttattaagtactggtcacacaacttggcccatatagagtaactaatattactcctatttctactaaaaataaatcctggccgggcgcggtggcccacgcctgtaatcccagcactttgggaggctgaggcgggcagatcacgaggtcaggagatcgagaccaccctggctaacacggtgaaaacccgtctctactaaaaaatacaaaaaattagccgggtgtggtggcgggcgcctgtagtcccagctactcgggaggctgaagcaggagaatggtgcgggcctgggaggcagagcttgctgtgagccgaaatcacgccactgcactccagcctgggcaacagagcgagactctgtctcaaaaaaataaataaataaaataaaataaaataaataaataaaataaatcccattagctgaactaaatagccaatcatttgaaatagaaagaaactgaattaaggcatttaggtaagtcttccattgattcatttactcacttgttttatcaattcactcctcaattatttatttgctttctatacagtgccaggcaatgttctaaacaagaagcagacagcatgggacaaaacagacacaattcttaaagatggacagataatacttataatgggtcaaatggtggcaaaaattataaagaaggccgggcgaagtggctcacgcctgtaatcctagcactttgggaggccaaggagggcagatcatgaagtcaggagtttgagactggcctggccaacatggtgaaaccccatctctactaaaaacacaaaaattagcagggcgtgttggtgcacgcctgtaatcccagctactcaggaggctgaggcaggagaaactcttggacctgcaaggcagaggtcacagtgagctgagattgtgccactgcactccagcctgggagacagagtgagactccatctcagaaaaagaaagaaaaaaatagaaaaattaaggtaatggagaacacagtgtggtgcatgtgtgtatgattatgtacattgttttattttttattttatacaggctggtcagggagggccttagggtgctatatgaagaaaaacctgaaggaactgggggaacaagccatgcaaagccctgaggaaagaactgttcaggaagagagaacagagatgcaaaggccctgagattgatgaagatgatgatgatgatgctaaaaaataatgatgtgctatggtttgaatgattgtctcctctgaaactcatgttgaaagtcaacccccaatgtaatagtattgagagatggggcctttgagaagtgattggatcatgaagattctgacctcattaataggttaatccactcatgcattaaaggactaatagattaatgggttgtcatgagaataggttagttatcacaagagtgaatctgttttaaaaactaggttggctgtctgtcacgagtctccctggtcatgtgatgccctgcgctgcctcaggactctgcagacagtccccatcagcaagaaggccctcaccagatgcagccctcctaccttggacttcccagtctgcagaactggaagaaataaatttattttctccataaactacctagtctcagatattcagttaaacagaaaacagactaagacacaatggaacaataacattgctatcctacatctgtgtagtatgttacagttacaaaaagcattcacctttataattgtttgttcctcccacgttcttgtgaaactggaatctccattttaccaatgtgacaaccaaggcttggagcagggtttctcagccttgatttgatagatattttgaggtgggtaattatttgctggggttggggggcggtcctgtgcattgtagaatgttaagcagcatccctggcctaacccctccctagtcatgacaaaaaaaaatgtcttcagacattgctaaaggtctccagtgaaagatgtgtgtgtgtgtctgtgtgatagagagagagagagagagagagagagacagagagagagagagagaggaaatcacccccgatcctggttgaaagtgactagttcaagacatcaatatgtcgaaattagtgagtaggtaaggagataagattagaatctgacccatatcccctagtcaggaaagtttaagaccatcaccctttccatagcatgaggagttttccgaagttgcctgcgtatattaatactggaaggtgtcatgtagtttatgggggtggggtggaggagagtgagatgaggagacatagtggggctatcatctccattttccagtcactggcctctacttcagtatggaatagcagctaagggagcaagatgcctgtctcctcactgctgtgttgttgctggatgccgaggaaacatcgtagctgggaactcttcagaaaccaagctcctgtcctgccaaagatgttaaccacccaggatggcttctagccaagttacaggggttcagcattcattccacggatgagaaagcatgcatagatgagaataaacaacttgtttaaggtactacagtttttaaatgtggagaagaaagggcactcaataaatgtctgacttggaaatgccaaggaataatgattctatgggctactgactgtaaaagcatccacattttgagagtcccatgggagccaggtacccgtgggaattatctatttgcaggcaggtcggtggcctctctaaccatgctcagtgggcagcactacatctacctgagcatcagtgagtgccctttccccagagcgtggagtctgagaatggccgtccattctcaccaggacttcataattctagtgtcccctcctgtccccacctgggacagtgggtagaaggtcctgtctgccagacatcctaacctcccagataggagactcctacatcctgaacaatgtcttataaaaggacacaaaaaaggtgaggattgtaagctgtagagaaagaaaacaacggcacttaaaagtgctcaggagataggatcaggagaactgctgtttacccactacccactaggcagcaaattagtcccttccagtcagggatatattcatttgcccattcacccattcattttaaacatatttagcaatctcctatgatgagtcaagacaaaggcatgggctggaacatggatagaaaggaactccttcagaagtggtgtggttgaaacgttaagatggcattgactagaaacagaatgtccacatcaaagccaccattccccacaaacgctgcatcccccatacacccagtattaacttgctgtgtaacttcagatacctctctcccctccctgggtctctgttgaatgaaatgaatatttcagacaacatgtcaataatagcttccatttcttgagtcaaaacactgtgctattttatatatatgatttccttaattcttacaagaatactgcaaaacaagtaatcccattttagaggtgaggaggttgaatctcaaaagtattagtaaggtgaaactggaccccggtgtgtctggttcaagagttgggcatcttaactactttatcctctgctgtcaaagttcttaaaggtctcttggtctctgatctgctgccagcctctgcctggctggtaaaacaaaactcaaggagttgaaagagagtggtatcctttcctagactaatctgtgcatccctacccttatactaatggagagtgaagatacataccttctagaaagtcttaaagatcctaaggcctcccgctcttgctacacaaaataggaagtgaatccattgttcctgtatactctgggttcccactgctcagatcataagggctgtctcaatttctccttcctctgggagatgtgagttccaatctctcaggaaggagggagaatttaggttaaggaacttaatcaggtggtgttcctgatgaagtagagagagcagcccttccaaagcagttgctaccactcagctcctgctaagtgctggaaggcacaagaatgggcctaaggttttgagatccttcagtcaccaagtgaggcagaaatgtgaatttctatgtgaaattttccaatttatatatattaacaactgaattcaaaaatataccctgtaggcaagcaaaaacaaaacaaaacaaaacattatgtaggggctaaattctgcctgtgagtttccatagtacaatctctattctctgctctcgttagtatcctcgcttctgagttgcaactctatgtccaaatcactccttctcagtttggccctaactgtttaccacctttgcaaaaattcattcccccattttccaatggcttttcatgtcactcacaggaagagtcagtgtccctttctatcaggctctacatgactttcttaccactgctcctataacccaatttattctagtgctctctctctcaatgctactcctccctattcctctagtgctccaatcacactggtgccagggacctttatacctgctgttccctctgcccaaaaagctgtttcctcaaatattcaaatggcttgcctcttcatctcctgtagatcagttttcatgtgttatctgatcattaagacctttcctgagggccctaattccctcctttgttttctttctcccccattgcaattattatcattcattattatatatctaatatatacatatattttgttcatttgcttatagtctttctgtgctagaaagaaactgctatagaaattgacttgcatatatcttatttattgctttatcttcagtgccttaaatagttcctgacacacagtaggtacttaattaaagcttgttgaattaatgaatgaaaaatagatgaataaatgttaccttatttaacaaatgtgtatggagacttcccaacagatattgagctaaacatgtatcaagaactttaaaacattcagaccatttgacccaataattccactcctgggaatataccctgaggaaataacacagaatagtgaaaatgaatttaagactaaaaatggttgttgatgttgaatacaaaatagcaaaaaaaaaaaaaaaaaagctgctaaaatgtccatcaataaatacattatgaagcagtcatgagatagaattacatgcatgttgaaatacttattgtataatattaaataaaaatgcaagatagaaaacaataatttttcactttcaatatataaaagggaaaagacagaaaaaattagtaaaaagttactgtggctattcaatggggcatacaaaaaattgctaatttatactttactttcaagtgttcactaatgagcatgcataacttttataattaagaaatattagataaaataaggactgatcatacttgtggtagtagtgatgaatttagctctacagtggataaagatatcaaatccagaggcaggctggttctttgtcagaggcattgaggttgagctgtcctggactttctttgtcagtcagttccccactgggtgagctccagccatttcaagggagcccaggacaggaggtacaaagtcccctgactgctgggaaactgcttcagctctgatcaatcagagaacagtcgcttcagcccctgacatttaccaaacctccttcaacctcatctgtcactatgcggtggtactgccttgccagccacagtctaatcaagtcagaatgtgcaagggtccccagagataaagagaaagcggggctctgagggagtagggagaaaggagagacagggagatggaaaaggatcatgagggaggaggggaagagcaaatgttcagagcatgcccgtttgttttgctatcatggcaattaatgctgggaagtgacattttaaggggctctagtgacagctttggtgacattcctgtttgtgattccatgacaaatctctgtctatatcttattttagagagtgtgtagagacagctcagaggatggctatcaggggatgccaagctcctgtctgttggaggcattgctgctgcctgctttgcagagcctaggcatttagacaccagggccaaacgtccaagaggaggcaccagctaagaaaccaaagcaaaaaagccgcagaggcagggtctggtccaggatggccttgtgaactccaccatgtggtacaattaattggagcaaaaaatgaatgctctgccattctacaagtgacatttggtttgtcaatcagtggcaaagaaaaaaaagaaaactcaattctgaatactttccaggctggctagttctaaggagcctattttcaaacacagatattgcctccttgttttctaagaagtcctaagatgaaaattaaatagaaataaattaagctcaaattttacaagctgagaattagaagagattacttaaattgtgtctgatctctccccatgctataccattttgacaaatgtctacctagtcttgtttgaatacttccaaagagtagttcatgatctttcagattaagagggggagagcaatgtagatataacaagttgtttaccaaataatattcaggatgtcacagggataaatacagtgtggcaaaacaaagagagtactgaacttgaacttaagggatgtgggtataaagtacaattgcaccatcaaactctctgtatttcatggatgagtgacttaatgtctcagagctggaacaaggttctgtgtctctcaaaagtgttcaataacacacagtttatcatataatgtttatgaagccattctataaatgttaaagtgctgtataaaataaagcagctattaccgttttatacccttcttaactgtgaccttttagggaaagactattccctattttgctatgtatgtctacattaaacagtcttcagcacacagtgggtgatggtaaacatttgttaaagaaatgaatatgaatgaatgaacaaatgaatggtgaggaagaggtgtacccaaagagaagaatcaggaagtaaatgcaatcctgtctccccctgtggctgtggagatggctaatgaaggaacagaggacacaggacagaactatgagccttcaggacatttaaaatgcaaaattcaaacatcactgggaatagggagaggacagaggcaacatggagaggaaagaggcagtttggtataaggatgtcaaggcactttgatgttaagaaagtcatttctggctgggcgtggtggctcatgcctgtaatcccagcactctgggaggctgaggtggttggatcatgaggtgaggagatcgagaccatcctggccaacatggtgaaaccctgtctctactaaaaatacaaaaattagctgggtgtggtggtgcacacctgtaatcccagctactgaggaggctgagggaggagaatcacttgaacttgggaggcagagcttgcagtaagccaagatggtgctactacacactccagcctggtgacacagccagattcagtcaccaaaaaaaaaaaaaaaaagaaaaagaaaagaaaatcatttccaaatttttcttcttttcatcctagagggcctatgtttcaaaaataatcccacatgcaaccactttaaagcagtcttgcttttgttaaaacaattctgcccattctatcttccccttgccctgcacgtgctcctggcagcaccctcaaggcacagtcaaatgggagctgctgttagtaagggagttccccaggctctctgaaaactggcatctggggcctcagaacagagtatggcttaaagatgggcagtaattcccatgcagggagcagagggcagggtgttgttgttgttgttgtttttcctttccccagggaagatagagcatcgtacagaaataagataagatctgaggcacaaggcacaagaaagggcaggttgagcacatttcataagagcaaatgtggaaatgatgggcccagtggcctatagggttgggtaaaagacacaagtggctggccatagaaatggcaggggtaagacctaaaaccctcatgtgggccttgcctggctcaggtaccatttccagttcctccaccaacccctcaaactgaagcccttgaattatcttcatccttcagatctctgggaaagaaatgtctcctgcaagccacctcagatccagttgtcatgcacctgttcccactgtggcctctggcactttattagctcctctaagaaagaggtttttaaacttaaggttatgacccactctcaaactgtgaaatcaattcagtggctccatcagcattacaaaaatgccatcaaaagaatagaagctatcagaacatggtcccatgtaatgacaatgtgtattattttgcaaaacttattttagagatgtgcgcacacacattcacacgtgaatatgtgcaggctcactgtataaaacatagttttgattatgtctgctgttcaacgttgtggataaacatagctctaagagacttagcttgctgacatctaagctaatgtctttcctctcctgctcatataaatggacaggagtaatacatgttgtgttatctccagcacatgcttggacttgggtatcagataaagctgggttcaaattctggttccattatttgtagttgtataaatttgagatgatatctagattttgataaggataatacattctttatgagatagatgcaaagattcaacaaatcattgacttgaaaatgctaaacaagatttgtccagtgcagagaaaagacaaagaacacatagaggttaccaatcagtggaaagactaaaatatccatcagtccattcattcattcattcattcattcactcatttattcctctatccactgacccagcatatttattaacacctgctatgtgccagggattgttttaagcacagaacaaacttggtactgatctcatggaaccttcagcctactaagataattaaaatacttaacaaatccaaataataaaaagtactattacaagaacaaatagtaaagttgacagaagacaaaagagaggaactcacatagagaaaagaggtttgtctgaagaaatgagatttaaactgagatcagaatgatgagagagagccatccatgccctgacagattggggaaggaaagagggtagttttccaggcaaagataatcatggcacatacaaagggcataggagaagaaggttagcaagtctgaagaacagagaagaggccattgtgtctggagcatggagggcaactttaagttgggactgttgtgactggagtgatcacaacagagtggctgcagtgtggagaagggaggaagaggatgggataaaagcaggaagaccaataagtaggtatgtgaggatgaggtaattgtggggatgtcaggaagattgatgtggcttgaagaggaatggacggtcatagggtgggaagcaggggtgaaggcgaggagtctggaaacttaggctagagcctcattgtgaagaagcttgaacaccaagataagacattgaataaggtgttgactctgaaagagctctgaaaattcatgaaatgctacacaaagatgaaatttacatgacattcacagggggtgtcagaagggtgagttaacaaacagcttctctgtttctgacaccctagagtgatctattgacaccaaacatgagttccctgcacccttggggaccactcgaaacactcccaaacaataggatctccctgctgcaaagttccttctgccaatttaggagctcagaattactgtgtaacagcttccttcttcagggaacacatgttgattacctattttttattcccagatttgtgagtgaagcaagcccatggttgctgtgcattagctctccctaagcttttaagagctcattgccgtcccaaggattacgaacctcagtgtggtgtagtgagttcaaatcccagctctgcatcttactacaatagctctcatgttggagttttcacctgactcagccatactccagctgtgttaccttgagcaagttacttaacccctctttgctttggtctcctcctctgtacagtagggataacattagtacacacctcatagggttattgtgaggtataaatgacacaattcatggcaagttcccagaagagtggtagaaatcagctgttgtcagcagcagcagcaacagtatcctagcctaatcaatccttccatccatcttctactcaggattaattacaaatggcttaatgaggtaatgtacaggacagcagctggcttccccacaggcactcaataaaagtcccttgtccctttctaccaacaagcattccattcagatttcttggactgggatcctgagaaatagcaaggttcagtctactggtcccatgtcccagagatcacaatgccttcctatctatcactgtcggccattgctggtatttaagggtatatctctcttctgcctccaccctagattctaaactgaggcaggagagcagagaaaagcttgcatactgcacacttcaccaaaagaatcatttttcatggtaactatgaggactgatattttacaaaggaaggcatttggaccaatgttaactgagggaaaaaaacaaacaaaagagaaaattatgcatataaaatgataacaacgatatagataaagaccagaagcacccactataatataagaacagtcagtttgatggggtagtgggttgtttgtgtagatctgtgtagaaaagcatacccagctccccttgagagaataaaacagactttttaaatggatatgccagcatttatcaaactttcaaatgcatgtgccttctgatgctgtgattctgatttttggtacacatctgtcctacagaaatattctcatgctttacaagaatagctagctaggtatacgtacaaagatgtttgttgacccatcgtaagtgcagaaaattaagataatggtcggatgtgagggcaatctggctgtgacatctgtcaccccattgatcaccagggttgattcagctgatctggctggctagatgggtgtcctcttcctccctcaatgctccatgtgcatccctcctgaagctgcgtgctcggttgaagaggataaccatctctgacagaggatgactggtctttagtcaagggtatatgagtagctgcactaccctaccagaacctctaaacaagctctcaagataatggtcaacaatagagggttgcaaagtttgatatatttggtatgttcttagcatgtgatccagcagtacagacttcagtgggagtaaggtaagtatgcatggctgacttgaaaagatactttctatatacattgcttaataaactatcaaattgctgcagaatgatatatgtggatgagataaccccactgactccattaatatatatgtaggtgcaagtgtgtgtgtgtatacacaattatatacactgatacacacacatccatatacatatgtatgtatgttatggctatattggaaaatgccagaagaatataaattaaataaaacaatatattagcctttgggtcctgtcagtggaatagaatgaacaggcaagggtagaacatttagttgttgctttatataatacaaacttctttttttgtctgaaaggtctttatttcatgttaattattgaaaaatattttgctgggtacagaattatagattggtaatttttttcctataagcactttaatgatgtaattccattgttttctggctttaataattgctaatgaaaaattagttgtaagtctaattttcttctttgaaggtaatgtatctttttcttctggctgtttttaagattttttttctttgtcctttgttttttaactgcctgaataaaatgtgcctatgtagtttttttttcctttatttcttctaaacaaaaggggggtacatacacagaatgtgcaggtttgtcacataggtatacatgtgccttggtggtttgctgtacctattgagtggtcctctaagttccctcccctcacccccaaccctccaacaggccctggtgtgagttagtcctctctctgtgttcatgcattctcaatgttcaactcccacttatgagtgagaacatgtggggtttggttttctcttcctatgtaagtgtgctgagggtgatggcttccagcttcatccatgtccctgcaaaagacatgatctcattcctttttatggctgcatagtattccatggtgtatatgtaccacattttcttttccttttttattatactttaagttctgggatacaagtgcagaatgtgcaggtttgttacataggtatatatgtgccatggtggtttgctgcacccattaccacattttctttatccagtgtatcattgatgggcatttgggttggttccacagccttgctattacaaatagtgctgcaataaacatacatgtgcatgtatctttatagaatgatttatattcctttgggtatatacccagtaatgagattgctgggtcaaatggtatttctggttgtagatccttgaggaattgccatcctgtcttccacaatggttaaactaacttacattcccaccagcagtgtaaaagcattcctatttctccatatctcatcagcaactattgtttcctgactttttaataattgccattctgactggcattagatggtatctcattgtggttttgatttgcatttctctgatgatcagtgatgttgggctgtttttcatatgtttgttggctgcataaatgtcttttgagaagtgtctgttcatatcctttgcccattttttgacagggttgtttttttcttgtaaatatgtttaacttccttgtaaattctggatattatacttttgtcagatgggtagattacaaacattttctcccattctgtaggttgcctgttcattctaatgatagtttcttttgctgtgcagaagctctttagtttaattagataccatttgtcaattttggcttttgttgcaattgcttttggcatcttcgtcatgaagcctttgcccatgcctatatcctgaatggtactgtctaggttttcttctagagtttttatggttttgggttttacatttaagtcttgtttccatcttgatttaatttttgtataaggtgtaaggaaggggtccagtttcacttttctgcatatggctagccagcaccatttactgcagagaagattctttccccattcctttttttgtcagttttgtcaaagatcagatggttgtagatgtgtggtgttatttctgaagtctctgttctgttccattggtctatatgtctgttttggtatcagtaccacgctgttttggttgctgtaggcttggaagtagcatagtttgaagtcaggtattgtaatgtctccagctttgttctttttgcttaggattgtcttggctacatgggttcttctttgactcatgtgaaatttaaagtagttttttttttctaattctgtgaagaatgtcaatggtagttcgatgggaatagcattgaagctataaattacttttggcagtatggccattttcatgatattgattcttcctatctctgaggatgaaatgtttttccatttgtttgtgtcctctcttatttccttgagcagtggtttgtagttctccttaaagaggtccttcacatcccttcttagctgtattcctaggtattttattctctttgcatgggagttttattctttttgaatgggagttcattcatgatttggctttctgcttgcctattcatgtaaaggaatgcttgtgatttttgcacattgactttgtatcctgagactttgctgacattgcttatcagttcaagaagttttggggctgagatgatggagttttcttttttttattattattattttttaaattttattattattatactttaagttttagggtacatgtgcgcaatgtgcaggtttgttacatatgtatacatgtgccatgttggtgtgcttcacccattaactcgtcatttagcattagatataactcctaatgctatccctcccccctccccctacccaacaacagtccccggtgtgtgatgttcgatggggttttctaaatataaaattatgtcatctgcaaacagagacaacttgacttcttctcttcctatctgaataccctttatttctttctcttgcctgattgtcctggccagaacttataatactatgttaaataggagtggtgagagagggcatccttgccttctactggttttcaaagggaatgcttccagcttttcccattcaatatgatattggctgtgggtttgtcataaatacctgttattattttgacatatgttccatcaatatctagtttattgagagtttttaacatgaagggatgttgaattttatcaaaggccttttctgcatctattgagataatcatgtggtttttgtctttagttctgtttatgtaatagattacatttattaattttcatatgttgaaccatccttgcatctcagggatgaagccgacttaatcatggtggataagttttttgacgtgctgctggattcagttcaccagtattttattgaggatttttgcatcgatgttcatcagggatattggcctgaagttttctttctttgttgtgtctcttcccagttttggtatcaggatgatactggcttcataaaatgagttaggaaggagtccctccttttcaattgtttggaatagtttcagaaggaatggtaccagctcctctttgtatttctgatagaattcagctatgaaaccatctggtcctgggctttttttttttttttttttggttggttggttattaattactgcctcaatttcagagcttgttattggtctattctgggattcaacttcttcctggtatagtctttgtagggtgtatgcatccaggaatttattcatttcttctagattttctagtttatttccatagaggtatttatggtattctctgacagtagtttgtatttatatggggtcagtggtgatatcctctttatcattttttattgtgtctatttgattcttctctctgttcttcattagtctagctagcagtctatctattttgttaattttttcaaaaaaccagcctctggattcgttcagtttttggagggtttttcatgtctctatctccttcaattcttctctgattttagtttgctcttggctctctagctcttttaattgtgatgttagggtgtcaatctgagatctttctagctttctgatgtgggcatttagtgctataaatttctctcttaacactgctttagctgtgtcccagagattctggtatgttgtctttttgttctcattggtttcaaagaacttcttgatttctgccttaatttcattatttatccaggagtcattcaggagcaggttgttcaatttccatgaaaatgtgtggttttgagtgagtttcttaatcctgagttctaatttgattgcactgtggtgagagagactgtttgttatgatttcagttcttttgcatttgctgaggagtgttttactttcaataatgtggttgattttagaataagtgtcatgtggcactgagaagaatgtatattctgctgatttggggtacagaattctgtagacgtctactaggtccacttgatccagagctgagttcaagtcctgaatatccttgttaattttctgtctcgttgatctgtctaatactaacagtggggtgttaaattctcccactattattgtgtgggagtctaagtctcatcataggtctctaagaacttgttttatgaatctgggtgctcctgtattgggtgcatatatattcagaatagttagctcttcttgttgaattcttcctgttaccattatgtaatgcccttccttgtcttttttgatctttgttggtttaaagtctgttttgtcagagagtaggattgcaatccctgcctttttttgttttccatttgcttggtaaatcttcctccatccctttattttaagcctgtgtgtgtctttgaacatgagatgggtctcctgaatatagtacactgatgggtcttgactcctcaaccaatttgccagcctgtgtcttttaattggggcatttagtccatttatatttagagttagtatcgttatgtgtgaatttgatcctgtcgtcataatgctatttggttattttgcacagtagttgatgcagtttcttcatattgtcatcggtcttcatattttggtgtatttttgcagtgcctggtacgagtttttcctttcatatttagtgcttctttcaggagctgttgcagggcaggcctggtggtaatgaaatcccacagcatttgcttgtctggaaaagattttctttgtcctttgcttatgaagcttagtttggctagatatgaaattctgggttgaaaattctttaagaatgttgaatattggcccccaatctcttctggcttgtagagtttctgctgagaggcccactgttattctgatgggcttccctttgtaggtgacctggcctttctctctggctgcccttaacagtttttccttcattccaacttggaaaatctgatgattatgtgtcttggggttgatcttctcgtggagcatcttaatcatgttctccgtatttcctgaatttgcatgctagcatgtcttgctaggttggggaagttctcctgaatatatatcctgaggtgtcttttccagcttctttccatttttcctgtctccttctggtactccaatcaattgtaggtttggtctttttatgaagtaccacatttcgtgcaggctttgttaattcttttttgttcttttatctctattcttgtctgcatgtcttatttcagtaaggttgtcatcaaactctgatatcctttcttctgcttggttgatttggctgttgatacttgtgtataattcactaagttcttatgctatgtttttcagctccatcaggtcatttatcttcttctctaaactggttactctagttagcaattcctctaacctcttctcaagattcttagcttctttgcattgtgttagaacatgctcctttagctcatcatggttttttattacccatcttctgaagcctactctgtcaattcatccatttgatcctctgtccagttctaggcccttgatagacagatgtggtgatcatgttgaggagaagaggcgctctgctcttttgggtttttagcattttttcattgattatttctcatcttcatgagtttgtctagttttagtctttgaggctgctgacccttggatggggtttttgtgggggcctttgttgttgttgttgttgttgtggatgatgctgttgttgctttctgcttgtttgtttttctttcaatagtcaggtccttcttccgtagagctgctgcagtttgctgggagttcacttcaggccccattcatctgattcactcctgtgcctggagatgtcactcaaggagtctggagagcagcaaagatggatgcctgttcctacctctgggacctctgaccttgagaggcaccaacctgatgccagtaggttcgctcctgcatagggtatctgacaacccctgttggagggcctcatccagttggatggcatggagagaagggctcatttaatgaagcactttgtgccttggtggagagggtgtgtttttctgaggggaaacccactgttctgggctgcccggattcatcagaactaccagaaggagaggctaagtctgctggtccacagagaatgtggccaccacactccccaggggttcaggtccagggagatctgaattctgtcccagagcctctggctggagttattggagatcctacagggaagccccacccactgaggaaggatgggtcagggttacacctgaacaggcactgtggccgcctactgccattgccggtgtgttgggctgtggggacaagtcttgggaccaagctgtgtagcctccctggctccacaaaaatttttgtgtatttttggatttttagtagagacagggtttttccatttcggccaggctggtctggaactcctggcctcatgtgatccacctgcctcagcctcccaaaggctgagattacaggcatgagccactgtccctggctgccttgatttatcttgattgatcaactgatggatcaatcacttagccaacaggcattttcagagtgcctactatgaagtgttagccactatgctggatgctacaaaaacaaagataaaggacactgtactctctctcaaagatctctaagtctagcttagcagacagaaagagaaactgattatttttgtacagtgtgggaagtggtcagttcaaagtaatcacaaccagctttaagagctggaagagggagtagattactcatttgggttgggttgaggaagataactgatgtagaaactgattaggggctaggaaaactcctccagcatttggagttcatttatcattggatacccacagcaaatctatgacctgggaagactggctgttaaaaaaaaccaaacaaacaacaacaaaaagaaaataaaagcattttccatataaggacagcaatgctcaatgagttatgctgcaaaagccaaaactaaaatatataggaagatgttttctgccttatctaagtgattttcttttagacaaaggaagcatgatgttttggcctgctggtattactgccaaatgaacatccttaccctttcaaggccatatttattgtctgaccttcactgggcactgtctatgtgggaggcactgtgctgggcattgcaggatacagagaaataaaataaatgcagactgtccttgttgtaagatgagaaatcacatgaaaatgataaataacatttgagaaggcaaacaaatgggggtagtgacaataaaccagcagttcaaacacagaagagcctatgatggacaaggggaatattcaaagcattccagagcagtgagcatatcatggtggctagagcttgaaggaaagctggagataaatattacagctggatttgagagaatctcagaagtccagctaaaactgaaggactgaggtctacacatacacatcttggggttcaagacttaccacgtgccaagtcatggggtaggtattttacacatcttttatttttatatctaatcctcccattaacccttcaaggaggaaactgaagccaagagtgttacattcccagtttcccaagatcacactataagtaaatgggacaagatttgaacccaggtccagatgacttcaaaatctatactctcatctacattatcactctactttctccctgagtttctaggattgaaaaaaaaacctactttttaaaaagccccccgactttttctgtttgtccactgagcatcaaggaaagatgggcctcagaggagaatctcaggagtagaaaagaagaatgcagaacccagagctccagggaaggggccaaactaaaaaataaggctttctttaggctctcaaaagtagcggtcggtgtctgaaccgggatctccagcccaaagctttcacccgttatcatcatcagcctcacaaggaatgaagagataaagaagaactgtgcctttgttgcatttgtctaaaggaaaatagctaaattccatctgtaaacaagctcaacgatagacagtaaaggcaaatgtaaacacatcctgtgcttatgtccaaataatcaattgtccccaaacaaaacaaaggaaatgggtctttgcaacaacatatgtgaaaaggagcaagaggtattagtcatcaaaaagtccaatgtgaggggagtgatgtcagcaagatgcatgataagagacacctggcatttatattccaacaagaaaggaccaaagcaatgaataaacagctaggatttgacctgagtgtcgtcgaaggcagagcaccgaaatgcagcagaagagtggagaagcatctgtggtgacaggaagtccatgagggcaatgtagagtcacccagcctctgaagcaccatccccctggcctggattagatttgcctagagtcaggagaaacttctcactgtggggaaaagataagcagaagatctctatccgaccccattgctaccacaaacacctacagtccctactacaggagaattccacagtcctcacaagccctgagcccagtttaaagagccaccaagaatttatacagctgcactgtcctggattagaagcacagcatgtgtacttctcacttccacccaccatgtgagccaagttgctgcagcacggtacacacctcatgagtgtgccctgctttgggggccaatagccatggcacctctccagcaatggggctccatcttcattaccccaagcccacacgggtggctgaatgtcacaagcccagctttacagagcttgggcctaaaactggctgtgactcttgtcctacagagcagagaaaccaacccccactaccctacttccagccagagaaacagtataacggtcccacccacagctatcctgccttgagccagccaaaccactgctcacccaccctcaagtgggagaagcctctgagcctccaagcagctgatataactccagggcagcagaatggctgcatgcctatgcacaggacctgagaactggctccagagtgcccccacccactacagatatatccctggcctgcctaatagttctacgccccctaaaagagcatgagaaactgtcccacaggacagccctggtgggcataccaccagaacagccaagcagccaacagcccatgtcctgaacctgaacagccccatcagccactccttgtggacattccctaggctggccaggcagctgcgcacctacataccaggcatgaaacagccctgcaggctgctcctggtgggcacacacctgagccagccaagcagccttgtacttatattccagacctgagaaacagccccttgggcagatatgcccacaggttggatgagcagctatatggccatgtcccaggtccaaaagagtcctgtgggccaccacccacagaaacgccccaaaccagccaagcaactgtgcagttatatcgtgggcctgacaaacagccctgtacccacccatggtagccatgcccacccaggctgttcaggccactgcatgcccatgtctcaagctggagaaatggccctgtgggttgtccccctcagacacattttcaggccagccaagcagccatacacccacatagcaggcctaagaaactgtttcaaaggcagctcctggcagatacacacctagaccaactgagcaaacttatgcccatgtcccaggcctaagaaacatccctatgagctgcccctggtagaaatatccccaggccagctgaaaagctatactcccacattctgagcctgagaaacatccctttgagcagctcctggcaggtacgcccccaggccagctgagataccacgtgcccttgctcctggccagaggaacagccccatggccctaatatcagggaatcagaccccaagctgcatgaacatccccctgttctgagaaatagcccagtgagcccaatcctggcaaagctgcaccaccatcaccacaaactctctcagcctaggtcactgagtatcttacaaatgtcactaatgtaaaattgtagccaatttaactacatagaaactctagtattgcatctaactaaaatccaggacagcacaacacaccaaactaacacctcaagaccaagttatacaaataagtctttccttatgaaacctactcaataaaatcagaagtaataatttttctaccacatgctaagaaatcaacatagggacacatcaaacatgaaaaatcaaggaaacatgtcactgtaaaaggaaaacaataatttgctagcagcagaccctgatcataataaaatacatgaactgccaaaaaaattaaataataattttaaataaactcagtgaggtataagagaagaaagatagtcaatttaactatatcaagaaaatgattcatgatttacatgatacattcaacaaagagatagataccataaaaaagaaccaaacaggaacaaagagctaaagaattcaatgaagaaagtaaacatatgaatcaagagcttcaacaatagactagggcaagcagaaaaaaaaatctaaacttgaagacagatattttgaaataacacaaggagtcaaaaagaaaagaaaagaaagaataaataatacaaaaaaaagaaagcctcaagtaagtgaaaaatattcatattaggggtgtttcagaagaacaagtgaaaaggtgatgaaaatatatttaatgaaataatagcaaaaaaatattccaacgtcttgggagagagatggacatcaaggtccaggaaaccagataggttaaacccaaacagatcttcttcaaggcatcttacagtcaagttgttgaaagtcaatgacaaaaaaaataaataaacaaaatcagcaagagaaaaaagtcaggtcacataaaagggaattttcattaaagtaacagtggatttctcagccaggagagaatgagatgacatattccaagccctgcaaggaaataactgtcagtcaggaatactgtacctagcaaagttatccttcagaaatgaagaagaaataaaatctgttacaggcatatggaaactaatggaattcatcagcactaggctggctttacaagaaatgctcagtgaagtcttacaactggaagtgaaaagataacaactatgatcatgaaaatatgcaaaactatacaactcactggtagagccaatatattttttgaaagagaaaggaatcaaaccttatcactacagaaaaccacccaactgcaaaaataataagagagaaagtaagaaacaaagaatacacaaaacaaccagaaaacactcagtgaaacactgattagttcccacctatcaacaataacaattattataaatgaactaaattccccattaagaatatataaacaggacaaaaggatgaaaaaataagacaaaactatatactgcctattaggaaattcacttttcctgtaaagacaaacatagaatgaaagtgaaggaacggaaaaatatactaaatgcaaatgtaagccaaaagtgagaacaagtagctggaattatatcagactaaacaggcttcaattcaatgctgtaaaaatagacaatgaaggatattatatgataataaagagatcaatacagcaagagaatataacaattgtaaatatatttacactaaacaccagaacatcctgatacataaagtaaatattactagatctaaagggagagacagactccagtaaaataataattggggacctcaacattttattctcagtattggacagatcatctagacagaaagtcaacaaagaaagatcatatttaaacttcactatagaccaaatggatgtgatagacaattacataatatttcacccagcagctgcaaagggcaagattcttttcatcagcacatgggacattctccaggattagccatacgttagagcacaaaacaaatctcagaaaattttaaaacactgaaattgtatcaaatatcttatctgaccacagtggaataaaactagatatcaatgacaacaggaatattcataactatacaaatacaaggagattaaataagatgctcctgaatgaccaatgagtgaaggaagaaattaagaataaaatttgaaaattccttgaaacaaatgaaaacagaaacacagcataccaaaatccatggaacacagcaaaagcagtattaagaggcaaatttatagtaataaatgcttatatcaaagaactagaaagatttcaaatcaataacctattaatgcacctcaaggatataggaaagcaagaagaaatcaaaccccaaattagtagaatgaaagaaatagatcagagcaaaaataagcaaaaagactaaaaggaacaaaagatcaataaaacacaaagttgttttttaaaagataaacaaaattgatgaactaatagctagacaaactaagataaaaggagagaacactcacataaataaaatcggaaatgaaaagggagacatcacaatggatatcacagaaatacaaaatgatacaaataaatacaaagtcaaaggctattatgaacagctataggtcaataaatttgaaaacagagaaaatggataaatttctggacacacagaactcaacaaaattgaaccacaaagaaatggaaaaccttaacagaccaaaacaagtaatgagactgagtcaataataaaaagccttccaacaaagaaaagtacaggaccagatggcttcaccactcaattctgctgaatgtataaagaagaattaataacaattctcccaaaactatttcaaaacattgaagcagagggaattctttctaattcattctacaagacatgcatcaccctgatactaaaaccaaacaaggacacacacacaaaaagaaaactacaggtcaatatccctgatgaaaatatatgcaaaaatcctcaaagtactaaaaaactgaatccaacatgtcaaaaagataatacaccatgatcaagtggtatttatcccaggtatgcaaggataatatatgcaaatcaataaacatatttcacatcaatagaatgaaggacaatcaatagaatgatggaaaaaaaaccatatgatcatctcaaagcaaaaaaaaaaaaagcttttgaaattttaaatatctcctcgtgataaaaactcttaataaattagtcacagaaagaaaatacctcaacataataaaggccatatatgacaaatccacagctaacatcttaccaaacaagacaaaaatgtccactctaatcattcttgtcaaacacaatactagatttcctagccagagcaattaggcaacagaaagaaatgacaaacatccaaattggaaaggaggaagtcaaattctcttatcttattcccagaaaaacctaaagagtctacctaaacgtcttagaaatgtgatatggtttggctctgtgtcttcacccaaatctcatgttcaattataatccccaaggttgggggagagaactggtggtgggaggtgactgggtcatgggggtagatttcccttttgctgttattgggatagtgagtgagttctcacgagatctgtttgtttaaaagtgtttagcacttctcccattgctctctctctctcctgctgtgccatgtgaagaaggtgcttgcttccctgtcgctcttttgccattactgtaagtttcctgaggcctccccaaccgtgcctcctgtatagctgtgaaattgtgagtcaattaaacctcttttctttataaattacccagtctcaggtagttctttatagcagtgtgagaacagactaataactaactgataaaaaaattcggaaaagttctaggatgcaaaatcaacatataaaaattagaagcacttctatacataaacaaactagctgaaaaagaaaccaagaaggaaatcccatctacaacagctataaaacaatacaataaaatacatagaaatcaatgtaaccaaagaggtaaaagatctctacaagaaaaatataaaacattgatgaaagaaattgaagaggatacaaaaaaatgaaaagacctcccatgctcatgcaatcttgagaaaaaaataacaaaattggaagtatcacactttcagacctcaaaatatactacaaagctgtagtaaccaaagttactgcaaagtaaatgcagtatggtactggcataaaaacagacacatacatagatgaatgtaacagaatagagaacccagaaatttatttacagtctactgactttttacaaaggtgccaagaacgcttagtagggaaatggcagtctctccagtaaatcatgctgagaaaactgaatatgcatatgcagaagaatgaaattagacccccacttttacccaataaaaaattaatttacaatgaatcaaagacctaaatgtaagacccgaaatgataaacatattagaagaaaacaggggaaacacttcaagacattggtctgaaaaaagattttgtaagtaagaccttaaaagcacaggcaaagaaaaaaaaagcaaaagtagacaagattatatgtcaaactaaaaagctcctgcacagcaaaggaaacaacagaatgaaaacacaacctacagaatgggagaaaatattcataaaatatttatccaatagggaattaatatccagaatatacaagagactcaaacattccaacagcaaaaacaaaaaacaaaaaaacaaaaaacaaaaaaaccctccaatctaataaaaaagtggacaaattgttctgaatagaaatttctcaaaagacatacaagtgaccaacaaatatacgaaaacatgctccttattagtaattatcaggtaaatgcaaatcaaaaactgcaatgaggtataatctcatctcagttagaatggctattataaaaaagtcaaaaataacaaatgctggtgagaatgcggagaaaagaaaactcatacactgtcatgcgaatgtaaactagtacagtcactatatagaacagtttggaaggtcctctaaaaactacaaaaagaactaccatatatctagcaatcccatgacttggtatttatccaaattaaaggaaatcagcttattgaagatacatctgcacctgcatgcttactgcaggattatccacaatagtcaagatatggaatcaacctaggtgtccaacaacagatgactagataaagaaaaggtggtatgtatacacaatggaatacattcagccataaataagaatgaaatcctttcatttatggcgaccttgatggaactgaagaacattatattaagcaaaataagacaggaatggaaagttaaatgtcacatattcttattcacatgtggaagctgaaaataattgacctcatagaagtaaaagaatgctcgaggctgctagtaggatacagaggatattagaagctgggaaaggtaggagggagacaggaatagggagaaatttattaaaggaaataaaattacagctagataggtgtaataatttctagtgtcctataccacttaaagattacttattaatgtaatacatagtttcaaataactaggagcttattgaacattcccaatgcaaagaaatgatcaatgtttaagatgattgatatactaattaccctgatctgatcaccatatatcatatggatcaaaatatcactatgtactccataaatatgtacgaacattatttgtcaatataaaaaaacataaaagaagtctaatatgagccagcaataactgtaacaaacaaatgggatctcaagctgcatcaatagaagtataacagttggcaagaaggagacaaaaatcccatttttctcagccctggatcattcctgccttgaggaagaagagtgtcagtttgggtgttatggcccaggatgtgaaaaattagaatttctgtctagacggcagtgaccaggaaggtgaaatgtctgaaaaatgctttatatgagactatttagagaaactggggtgtttaggttgtttaaaatgtacagtctcttttatttgtgttgtcaaatttcccaagagctgctgccttggaaaaagaatatcagatcactttccttttggacatgggggaccgtgaacacagatttcaagttggtataagaagaaaccctctaatagtcagtaattgtgtggaaatgagatggcctcttttccgagtagtgagaaagctgtcaaaggaggtaatcaagagacactggaaagatgttggactgcatagcctctgaggctcctcacaactccaattctgggagtactgacactcttttattctctcatcactactgaagaatcagagaagacaaacttgataacccaacagaaatctaaagccataaatccaaagtggcttatcccagaaaacactgcctgtagtccccaactgcccagcttctgcacctcttcccatcttttcaaaatgccccctggaaaatgggctgtgacatggaggactcacctttcttctcaaagtccaccttctcttcccctggatgtcccagactgtccagagtgtgggtcacctggctgccaaactcgtcctcgcgggagacatggttggcccgcctaggtggctcctcatcctcctcacagtcatagtcatccaggatgggagtctcccggatgggcacgccaatgacggaattgtgggtttgcagccgggatgaacggaagctctcccgcgcctggggacccagcagcacagatgggatgtagtggatctcatgagtggcttctgtgcttgcgctcttctgggggatgcggcgacgcttctgccaacgtcgctgggcgtacagcgccacggtgaacaccagcagcagcagcagcagcgcgatgaggccaccctggagcaggaaggaaggacacacaaatgggccactgttctttggaatcgagggctgcaggggattttcctgtccactacactctgccaggatccctgggtttggctcatagagcctcaggaaccaccagccgtggtttttaagctagagagacattgtttcaaacctggctttttcaccaacaaactatgtgaccctaggcaaacttcttcacttctctgagccttgctttccatagttataaaggttgagtaggaatccctgctcttccttcttcacaaggttgccataggaagcaaatcagatggataacggtcatgtcagagcaatacagatagctcagtggcaggaagggtcagtgctgcggcttcacacaggtgaatgtctgaatctagactccatctcccaccagctgagcatcccaaggacagttgcctacgctcccccagccttgcttcctcatctctagaatgagttaactgaaagatcatgagacagtagtaggctgtcttacatcttgctgcaaatataagatagcattattaaatcaaacataatgtctgcatagtctgtattttcttcatttttcagaaacaccagtctttaaatttctgaatttctataagggaactgggacaaagtaggtccttaacaaatatttggtaaatgagtgaatgaaaatgtacctttctagggctcctttaataagaatttcaaggtcaactgatatatatatatataatgtgtatatatatacatttttttctttgatacactcagctcctaaatatttgagtctgcattatcctacattaatttgaaataagctaatgtgttaatgcacatatcttacatgattcatgaaatactctggtctgtaagatccttcagggcagaggtattttcaaaacacgtctgtaatccccataacacctgtcatgagcttgaagttgagggtttgcattctccaggcctcccctcaattgttctgtgccagaaacctctcctctgatgggtaggccctcatcacttctcttgcttttcttcactttatactctgcttcatgtttgggagattggaagacactttgctgaatgcctgctgtgtaatccctagagtcaggaggaatcacccttgttgtatacagggtagagagaggcttcaaaaaatcaagagacccagaaactcagagagcaagtggcagagtaatatctgagccttactttttgtgtgtttattttgtttgtttttgctttttaactctagagcctatattctttcaatccacctgtgtggttgatggcttctccttggctatgatctcattgaaggcaaggacaaattctgacaactatctgtacagcatctaacaaagatgacagatgttagctgtgaatacattatcttaggggcaaaggtggctgctgttaaacacacctgtttagaccaagaagaacactgtttgctgaaatgggtcagccatcctgctgactgtatttgatattagaaaactggcatgttctatttgcaagaccctcagctcactatgctgaaattcagcacctccacagaggtagggggactgggtggataagaggactaagaggtggtggccaggtatgcaggtgtggctgatagctctgtagcaggggcccaagccctgccttgagttcagcagtgagctactttggtttccccaagaaagtttctctggatgtcataacataaaaacaaatgcacaaatcaagcaaagctataagtacgtgtatttatgtgtgtatttgtgtgtgtgtgtttgtgtgtgtgtagaatctattaaatatatgtgtaaatgcatgtgtataccagaggtgattatgtatatatcaccttaaaaaacaacaatgaatcttttttttcctctacagaacatatgatagtgattgctttgtgtcacaaaattatgtgtgacatgatattatttgtctgggatttttttgtgtttcagaaataagaaaagaaggagagggagggagtgaggaagagtgaagaggagagaggtgatagagagggagagtgaagagaggaaagggctgggggcaacactaatccttgataaacacaagggctgaccctctccttaacacctttactgaatgtttttttatttaatctttaagacaagactatgtgacagaaattagtttatgctgtatagatgaggaaaaggtaactcagagaagtaagtaactagcttgaagtcacacagtcaggatttaattccaggtccagctggattcaaagggccaggaagtggtggagctgtgactgggccccagctccccatttcacagcccttggttactgaacggcaattctcactgactaaagagagggaaggggaggaggaggaaagatggtgagggtgcatgaaaagggaaaaggaaagtattattttcaaattcagcctccagatgtgcaatgggtgcatcttctcttcagagaagattttcattctggcccattgatgcccctgggggaatctccttgcctgaccatgccctctgtcttctcaactttgggcatttcattcagtgagaggataaggtcttacatggttcctgggccttcattcctcatcccactcagtatatcccgattatggttgtgggactctgtggtcagatcccaggaccaatactgacctaggaaagatgaggcctaaccaacccatccacctgcaactactaatgccccttcttccttccttgtatcctttgccttgagagccttccagtagtaaatggctaagtgttggcatcagactgacatgattttatccaggttctactgcttagacactctgtgaccttgaccagtttattttatctttctagatctttggctttctcatggattaaacaaggacaagagtcataatgccacctcattgggtcatgaaggctaaataagatgcttgtggggtatttaatatagggtaggggcacatagtatcataggttgttagctgctgttactgtcaacagaattcagcaagtatacattctgtgttgaacgaataaaggaatgaatgaaggaatgaatgacttgagtttctggccctatatacctattctgcacaacttgccttggatccccaaatccttttcaatctggaccaaatgtttgatatgtgctctttcattcacctttacacctatcatcatcctacattaagttggaaactcaggcatagagacaaacgtcatttactcaagatagagcagctgagattcaaactagctccagcatgactttaaaaccatgctcggagtggagaaggcacaggagcaaaagcctacttagcccctgctcagtctcacttctgccttatcaagttacctacacaatttcaggcacagatttctcaacataggaaacttccagaagaatgtggcagagggaccccctggtttgggaggcactgagcttgaggttccctttagtttattgacccattgattctttagcccttgaccttgccatttgatatgagcccaagccagtggctatggctatccctttagggcacaggttcattgtcctcactccccagcctgccctgaactcagcttccatcacctccaactgagtcactgaccacgtggtttccgttacagattcaagttttattgcaagaacttggtcaaagcagatttccagtattctggggctcatcgtgccactgactactgaaacagacatcccaggctgggcttctaaagaactcaggaggcatcatctaaaacatggtagcagcttaggtaacgttgcaagcaccaatctgaacatccctccctccctagaccctgaaaaagtagtggaatacataaaattggacacagtctcagagcatgtgggaaaaagcttctaaattcaagtttacttactttctgaccttggcttgctcctatggaccttcagtttattaatcagtaaatcggagttggccaatacttgtaatactatatcacacagttagaactagctaagactgggagtcagaaacacaaggttgaaatctaatgctgcacatataagctgggctatcttggacatagaacttaatttctctgattaacaattttattatctataaaatcaggtcatagacttctttatcaagggaagtgagatgtgaactaatggacacgggatactttgcttagtgcctggcacatggtaaaccagtgataggagaaaatcttcattcatggtaccccctataggctgctgtgcaaatcaaatctgaaaacagctgtgatatcctgtaaaaactgaagagtgccgtgcacaagcaaaggagctcaagagaaccatctggctgcttctgtcatagtgagacatctcacccaaagaatgcagatgagtgactcagaatcaagaaggaagtgtagactgtgtccacctgcactggtccaggcttctgtcctggtccacacccatagaattacatactcccttctttaacagcttcccacaccagaggtaagcaaacagaaaggcaggagcaatcgaccagtgctcagcacggccagtgtgtccagcctctgagtccacaccaggagcaaacacaggcccaagcagtggaaaaaaatgctgcacggcaaaaggggagctgaggaggaagaaaaagacctaggaagatggctgtgaatttttagaaagcaagttaagaagaggcgaaatctccaagggtgacaagctgagaccctgctggcctcagggacgatctgatgccaagtccgatttgtaccgtgctcactccagggcagccctaggcaaacaaggctgaggaagtcactgcaagttctagaaataataacatcagtctattagttacagggttgcttctgtgaggttgtaagctggacagatcttggggtgatttgtttttaccatcaccttatgagaatttcaagaagctttcagggaggaagtggagaagagatgtgagaaagaaagtgcacccctatcccttctggaaccttccctattacaagtctctctaggcaggatcagcctgcttctcttgttctattactgacagtgagtctcagattccccatgggaacaagacaagggtgagggtgggaggtgtcaagggcagagtgctctgatggggaaaccaggtgcctgggggcatacaggccagcatgagaatccctgcttctctccttgctgttggctgtgacaagttcattacattttacttccttggactgcaataggctccctttaaaatgaggctgatagttcacagtgtgaagagttatgctaaggattaaacaagacattcaaaggtctggataaaggatctggcaccacaaaagtcaacaaatactagcatcattccttcagcttccctatttgtctatcacaaaccaaatcctttcaccccagttccccttgcttaaactcctctcctggcttcctggggtccttaaaataatgtccaggttccctagcctggtacacaaaacccctcatgactgggtccctgctcattccccagctccccacaagcctcacctgtcctacttgtcctggagtcaccctgggcagttggcatcctccaaagtgtgatgctccctcttctgcactctctatcccctcagcctgaagcaccctctcactcactcgacctggaatctcagaaggtgacttcagttggaaataggatatttgcagaggtaattagttaagatgaagtcatattggattaaagtgggccctaaatccaatgactggtatcctcataagaacaggagtggacacacagggaagaagctcacatgaagatgaagacagagatccaagtgatgcatctacaagccaaggaatgccgatggtcatcagcaaccatgagaaactggtagaaaggcatgggacagattctccctcagagcctccgggaggaggcttgctgacatcatgattttggacttctggcctcctgaaccatgaaagaataaatttctcatgttttaagccactcagtgtgcagtaatttaaatggaagccccaagaaactaaggcactgcccttgacctcttgatctcagcccattcagctgtctaagcttggagatcacttccccagggaacatctctgcattttcaggttgaggtgaggctttcatggctccagtcctctggctgttgttatccaatcatctgtttgaccattttcccattcaaggtcttgagttgccatttacctctaccatttatccagccttagttccagtgcttagcccagggaaggtgcttaataaacacatccagaagctgacaatcttcaccagactttccagaggaatgcaaatgcaagtacttgttttagctctgatcccagcatcaacaaggcacctgaccaaacctcgtatgcccctttgctgcttttactttctccaatgccagtgccttcagctggttttcttacgtacacaacctcaaaaacagaaaaatacacagagagataaaaagtataaagcacttcaaaccaccccaccaagagagccttctgaaaagtcaaactcagtacactgtttggcctggcctcattttaatctatttttcatgttaaaatatcaaggcatgaaagaaggaagcagagaaaggaaagaaagggataatatgaaaaatgctttatttgacaatgtgtcattcagaaactgattatttctgtctctggcctttttaatattccctcactatggccaagccaccaggggatttggtattctaagactggatttataatactctgttctgcagtgataagaacacaggcctttaatcctcagagctgtgaacatgcatattctctcaagtaatgtccttctcttctcgtcacttgtttctggtccctggcagccacgatgccatgatggctgagaactggtgatccactgggccttctcttggccacttgcctaatgacagatctagtggggaagggggcccgggatccaagtgatccgagacgtctcctttcaggccccagtctatgtttaagctggaagaattattagaaaatagtctaagtctttagtgttagaagaaaaaaaaaaaagaaaaagaaactgagactcaaagaatgaaagtgacttgaccaacatcacaaaccatcctaaaatagttctggagacagaatatgcagccgactccctccaaagctgctaaggaaacgtgaattgtgacaatttgatctacaaaatagcttctataactttccatttctctctactctatgactgtcctatgccctagttttcatggattttcatcatgataattttaatacatgctgaatgatcttccaggctttattcctcctttcccactatgctcaatccatcttacttaccgtaactaaggcacacatggaaactgatcccttccccattgactaagctaagaatcctgtagtttgacagttcaagtcctcatcatctatctttgtggataaccttgtctcgaacgtatgcttttgaaatgcccttcttcaaatgtgtgctttggccgtccatgcaaccacccctactaagctcttgctacagagaaggcatggtgccaagtatccaaccacagtgaaactctctgctcccagtaagctggggagcagagactggggcctgaaaggagacttgtcagagtacgtggagcctgagcctcctttcccactagctctgtcattaagtgagtggcgaagagaaggcccagtggatcaccagttctcaccatgatggcactgtggctgccagggaccaaactctcagtcctgaggtgtttttgtagaagccatttactttacctggaatgatgccctcattcttattcctcacccttatgtctacacatccaaataccacccatacttcactgttaacttcaatgcatctactttatgaactcctaggcttttcccttccccaggtgcagccagaaggaatttctttatcctctgcactcccacagcgcttcgccttaaccctcacttaaggatcttcagcatttcctaccttgtattagagttgttgatgctctttacttagctgccctacaggttagattattatgcccagtgtacagatgaaaaaaaaaaggagactcagaagagaaactgcttaaaaccatacaaccaagtagaaaacatatatgataagattttccactgggggcaattcccaataaaccatgggttcactatctcagaagggagcagctggagaataagataataagaaagttcagaacatattgcaaaaggcataaggatctaaagacttttagacactgaggatctaaaatttttttatgccgtagggtggcaaaatcagctgtataccttggaaagatcatagtgggcatgatggggagattgaaaacagggataccattgaggtagattttaacaagggtctaggatggcagttctcaactggtggcaattttgccccccaagaggcatttggtaatagagacatttttggttgtcacaacttaggggagagagtactggcatctagtgggcagaagccagggaatctgtaaacatctcgcatacacaggacagccacatacaacaaagaattaactggtcccaaatgtcaatagcgcagagtttgagagtccctagtctaagagagatgatgagaccagaactaagagagttaaagtggtgggtcagctaacaggataggaagacttgtgtctattggtggggaagggggtgtcaacaatgacactgaggtctcgattctgtcactggattagggagggacctatctatctacgtcttattttttcttgggtaatcttccagaaagttatacaagataccagcatgtaatcaaatgaagagatacatttacatgtgtgaacaataagggaagaaaaaggcacaacaaataagaatttgcatgtatacatgtatgtgattatgtatgtattcacatttgtaaaaatatactcacacctatgttaatacatctatagttagctatatttatctatatttcttttttgcctctagacagatatacggtgacctatttaagaagtcccattatataaaaagaaacatgtttctctttaaaataaatcatctacttaccatgtatctattagagatactattttacttccaaagataatgccaaaggagtaaagtaaaaacacattggttctttggaatgcattcaccttccacccactaccccccagctcaatcttccttaatcatctttagatcagattagaacagggtcaaaatcctgggagaacatactgaattctataaaaatttatcaaggagaaagctaaggaatgcttggagacaccagcgttttcccgtaagttagacagacataggttcgtctattgacatttttgttagtacagtcatgactcaaatctatgtctgtttgacttatatggctttggataagtcacttgagtttcttcagttctctcatctgtgaattgggttactaacacctaagtgggagaatctgtggaggattaaatgcgattgcagtgtataacacagttagctaatagcttgcaagtagtggatctttattattgatgtaagaccttgtttcctaaaaaaaaatttgatacaaagtagtggtgaaaccactacttcccctccactatacaatcagatattctctatacagtttcccagctgcattcctcccataggctccaagcggtgattgtgatcccttcccctctttggggtaagtaggtgggattggatggtttctgacagccatcccagctctaatattctagaaaattaaaaaagcaaaggcaaactggaaagcgttttggaagagatgaaatacatacattcttatgacatcttgcctggtattacaggtgtaaatgcatacattaaaacagttaaccacgctgtatccttcacaccatttcacgtttctgtgcttttgctcatgctccctctatctgaaatacccttccctcacttctttgtcgagtcctttaagcctcagcttgtgggtcatgagttctctgaaacctgctttttctgactgggttaagtaccacctgttaggtcttgcagtgactcatgcttttgtctgccagagcatgccgcagattgcatcatagtttgaccccctcccatcaccctagtgcccattgagggtgttcttaatcatctctgttttcccaggatccagctcagggtctgacactgagtagccctcattatgtatttattgtatttctacactgagaggcaatgaaaggaagggcagggttttatttatttctggttgaatttgaatggtacacagcacagagtagtagatcttcaattacttgttgaaagaaaggacgaataaatccatcataaatgcctctctaagggcaggtgaccaaaatacacctacatctgtctggcagtcctccatctgtctgtaagagagggctgaaggtaattcgcatgagccatttaacacaagtcagcatcccactacatgtcctcaggtggcctctcaagttctgtcgcaaatcccactctgaaggacgggtgaatggagaaggtaggggaaaacatctttaggaggattgagtttcttcccactctttgagtcatgaaaatatacagatgggccaggcacggtggctcacgcctgtaatcccagcactttgggaggccgaggcgggtgggtcatgaggttaggagttcaagaccagcctggccaagctgtatgtatatatatatatatatatatatatatatatatatatatacagatgaacccaagtggccagagaggagctttgccctcattcattgatttacttattccccagggtaaggtcatacctggaagcaggcagacctaagttcccatttttactctgccacctaccagtaatgggaccttgggacattctctctgtgatgctcagttttcacagctctaatacaggaataatgccattcaccaaaaaggctgttgtgaagatcggataaggtgatatgtataaaatatgtcacacagcccttgacctgcataaaacattcaatacgtggtagtcattggcttaactcttactactattattgtaattttctgaccctgtagcaaaccttctgcctcgatttagaaatacacaggtatgcccttgaagaactcacagttggtttgtggcaacaggtaagtaagcaggcagttatcacaatgcatagttcagcaagctccatgtaagagggaaacatggtaaggggcaaagagtttctcacagcttccaagtgtaaaacgtagagaaagtgaggataaaaaagatttttcttgcaattccaattacagtcaagttcaaaggtgtgaagaacatgcccatccaatcaagtacactcttgcccaaaatgtgacagaagactggataatcagctaaactgtgtagtggttaatggtgcaggctctggagttgatggccttgggtttgagtacctgtgctgtcatttaccagctatggaaccttggataggctactaaatttctctgatcctcatctttctcatcttaatgagactaacatttcatcactgaaatagactattgtgaaaattaaacaagtgaatgcaaaaaggaatccaacagtgtctagaatacagtcaatgctcaacaaaagatgatttaaaaaattctggcagaggaaaaacatattgagaaagaaaccaggcaacttaaatcccagtccttaccttacccccttataaagtaaaagaagtttgcagaaagctcacaggtcctcataaagcgggtttgtttgtttgtttgtttgtttttttaacagggtggccatagcaagcaaatgaactaggcatttctaacttcattaacagatgacaaaagtgagcctttcaagaggggttttgcccttcaaggctgaaaagtcagtgacaggacacacatttggctccagaatcctgtttgtctgctgcatgctgctacaatcatcttgaaatgttcggtgtgtctggagagtcggcagaatgaagagccttcatcctttgctcagtacattattccctgggaatgtgttgcagattcacagggctgatgtgagatccctaatattgtgccaaccttaaaatactgtgccaacaacaaagccttctgaggtcagaagtagggaaaagagaggaaggtggaggccagtgagagcctggtcaacactaatacatgaaaaataagtttcatatggggagggagcttctgaagggagctggcagcatagtgggtctgatgctggcttctttagaaatcatgggtgggggttaggggagttggtgtgggtgagggtcatggtcagggattgctgatctatcaccaagacagagtcacgttggtgaaggcttccctttgcacctgctctaccacagtgctcttcacctttgtctccatcaccagatctctatttcctttccttgctttaactttatgtcacttatctctcacttttattatattacacactaatttgttaactttgttcatggccttaatagaatggagcttccataatgtagggccttttgttttgttcattactgtcttcagcaccaagaacagcacttagtgttttgtcaatgcttagtaattctttttggagtgtatgaatagattaatggatgcagggatgggtggatggatggatggatgaatggattactggatggatgaatacatgagtaaatagatagatgtctctcagaatggtttagtagctcctcaaggacaataactagatatgaattatttattagcctatacccgaggaccgaaaaggctggaagatatgtagtgaataaagaaaacattgctgttagttcccttttggtgcccaggtaaggggtactgggtatagggataatgaagacacaaatgtgataactaactgttaactcctctctctctactgttggaccaaagaggaagaggtggtctgaattccaagcttgtttagtcatttatttatttataaatacttagggagatactgagccagaaagtaaaggggtgaaagggatgtcagatgcaactcttcaagcacaatcactttacacagaaagcaacctgatagctgtatctatttgttattactattactatatctagatggaaatcataggactttagtgaaagagggtgtcaataatgtggctcaaaaaacactggatttgggttcaaattctgactgggtgattagatgtacattccttggctagccatgttacctttttcagcctcagtttccccaggtttaaaatgatcaacaataacaggtgccttttcctctttatgtaaggacttcattgataatcatgtttttaaaagaactatatatgttatagagtaatttacacccatcagaactttgtatataggtgtttgttaaagagagggactccaaaaaccacaggtaactcaagcagagtaacttaggcgcaaaagaaacaaagctgcaaatctgccagctttccaatacttctgatacttctgtcatctatccatcaacctttttcaaaacctattacaagtcacacaataggggtctcttagaggcattgttttgctgccattttacagcattgatgctgtagctgccaattgtcttgacggcatgttgtgatggtctcaggatctcccctaccgggctagatcaagaaaacccctggaaagttagttactaggggcagagagtcaagcataagatgcccatcaatgagaagggaaaagagagaggagtcaatgggaggtgctctgtggcatgataggaacaggaattaaaagctggccagtgtccttgatgtacccaccagggctgagctggtatgattcattctttctcttcaccttgctgccctttgtctcctgagtatttaaagacgtggagttcaggccagtcttggtggctcatgcctgtaatcccagcactttaggaggccgaggcgggtggatcacctgaggtcaggagttcaagaccagcctggccaacatggcaaaaccccatctctactaaaaatacaaaaattagccaggcatggtggcacgtgcctatattaggggggctgaggcaggaggatccttgaacctgggaggcggaggttaaagtgagctgagatggtgccactgcactccagcctgggcaacagagtgagactccatttcaaaaaacaaaacaaaacaaaacaaacaaaaaaaaccatgaagttcaatatctcctgagtaatccaggtagtagagataattgcccagctacctgtcaccttacccttaacaactcctctcatccctgagataatttccacccctgctggcaggacaggcaacccagggcccaggctgcaggggaatctggtagaccatgctttctttcctggttcagagaacatctcagttgtaacactgataacgctccccgcccccaagccctaccatgagtgctgaacctcgatctgttccctgagatcttgctgtcacacacaggactgccccaaggtggatctccaagtcctgctccccacattccctcgggttgtacatctattgccttccaagacccaccctcatatccagctccagctgggctacccaagactgggcagtctccttaactgaatcccagggtaaaatacaggaactcaaagctccagcatattgtatccttaagtggtcagcgatagcgtccccaaactgccacccaacaggacagcatttgaagcactcattgagcctgagattggaaagatgaggtctggaagagcctgggaactgtctaaacttcagattaattagatgaagatgaacttaattccacagctactgaaataaatgttcatgtcacacagccgtctccaacccatatcggtgaggggtctgggctcactcaagaacaactagcctgggttcctggcccattcagagtcctgtgtgttttgaaccaaccagcaggtcctgaggaaatggactgaggtggaatagggactggtggtattgggaccacttcagagaaagtctttatttctggccaggtgtggtggctcaggcctatactcccagcatgttgcgaggctgaagtgggagaatttcatgaagccaggagattgaaactgcaattcatgagaatttcacgagggtaggagattgagaaacatagtgaaaccccatctctacaaaaaataaaaataaaaaaaggcatggtagcgcacatctagccccagctactcaggaggctgaggcaggtctgcttgagcccaggagtttgaggtaagactctatcttaaaaaaaaaaaaaagccctattgatcctgagcctctgtggaatctgggtgtgtgaatttcttcaggctgaaaaaaaaaaaatcacccaaactgagtggcttaaagtgttagatatttatctctcttagttcaggaggccagaagtctgaaatgaaggtacaagcagggccaagctccctccaaaggctctacaggagactcctcccttgcctcttctcacttctggtggctcctggaattaacctgtggcagcatcattccaatctgtctccatcttcaaatcaccttcttctcccctgtgtctctctccatctcctcttcttcttacaacaataccactcattggatttagggcccaccctaagtcagggatgatttcatcgtaagatccttaattaattacatctataaataccttatttccaaagaagattatattctggggttctgggtagacatcaattatgtcaggacactattaaaccccgtacactgaggaaggatatctaggtccattatttagttgcaagagtcactgaagcaacccatagtaagtgaaccaaagagattgagccaggaaagaaaaggtctaagagagaatgaaaataagacctcttttctcattcctcagtggctattctggggcagagggagcggacagtgcatgcatcatggaaaggtagcatcatcagcaatgacgaaagattccacagagaaggctgtggactgaaaacaatacaaaatatacaataaatcctttctgacacagtaaactccactcgccttttaagacagagcttgtgtatcttcttgaccctcccagatagagttgatcatccccaaacttgcctggtcataaataacacctggggatgctcattaaaaatacatatttctggcctttaaataagcctgcaggagaccttatcatcaggtagggttggtctgggagcagaagagtatttaaatcctatctacagcactctctgagtttctgatcacagcaggtcaattgattcagtatatctcatcttccttgtctgtgaagtgatgttagcagtagtatctactttaggattacatgcatcactctgctgagtgatgaaaaccatagaaattcttagtaatagagagccaggactattgccaagattacagctgtctacaatggccctaggccactctttggcatatatttgcctacatacctgccatccctgactagtccttcttatttgtgtatgccaatgtagcttcttggttaaagctcagactctcgatccatgaaatttgagttcaaatcttattgctactctattggttttgtggcttcttacaagttactttattctgtatctagaaaatggggataagcaaatctatctgatataattgtaaaaataaaacaaaataatcgatacattggtttgaattgatttaaaatccaaaacagaagtggaatttgtggaatttggggaggataaagggggaaggagcttgttgtcactggtgaagtccaagaagccaacggtttaaggagagtttggaaaggggagaatagaggcagagagagtgggaagcgagtgaggaataaagggagcatggaaaggaggggagagtgtaaggtgagagaggatagaaggaagtgcaggagagtagaaagaagcttctttttcaagaatcccagtggtgttcaaatcccatttctcaggccattacaaacataagaatctcgtctattttgctcagaatcttcttccttgttctctgtcccgacctagaggctgctgacttgggctgtcagagggccactaagtgagcacaccttccttttctcatcattgcttttcagggccctgcactcggggaagcagcccagaaggggattagaagatctgtggagacagagctggagtaactgtcttcaccctgccacctccatggggctgtataacaaaattacaaaagccacccagggtaagtgctgctacaaaagtaacagcaaaaggtaactgtcaattacaaaagcatctaggagcctcattttactcatccgtttaatgggcatcatgagggtcccatgagtgtattgtcttgttttgaggattaagtgaagatgtgcatgtaaacactctggatagtattaggaaatgtttcttctttataccccaggttttgatcaagataaatttcccccaaatctctctcttgcccaacatcctttactcctccccactaaggtagactggatctggaatgaggctgtgagcttgcataactctttcccttcattgcttcttttgccgtaggaaccagctgccctccaaaagcagccttctgctctgccctgccaccccttctgttttgtgataacagattcccatgtgagagggtgccaggcactcagcacttaccctgggtgggaaaatacccatttttgccaagtcctccaaactaaccttttgcagtaataaaggcaaaacattaatctccatctgctttactccttttactaatctttcaaactgttctcaattcaagtggagaaaatatggggcttccacaaatcccatgccgattacctgggtccaaagaatgttctcagcaaattgttctgttattattacattcaccagaaactctattgtctcttctccctttgttgggagcaattttttttctttttttaatttatctctctaaaagctttcacattttcccccttttatccatacagttctgaaatttcactgcaatgcaactaggtacagatttttttttttttcctttttgttcctcattcatcatgtttggtaatcagaggacactttcaatctgttgttccttccttctgctcagggatgagttctggcattatctacttccttccctggctctgcctggattctggagctcctctctttgctgttaacaagcaagtcttctaggaggtgagctggagcttgcgttcttccagtttcaatctcacagcctccctgcatccagggctctgtgtccttctgaggggcagagagcaggctgagaataaaactcctgaagaaatcagggaggggctgcaactgggaggaggccctgcttccaattcccccaagcgagcatgtgttcctcgctccaaagcaggaaatcaaacaaaattgctggacctaaaccagtaccaggctcagtggaagccaggaactggcaacttaatcctgttaatgagattttgggcaagtcgctcaatacccccttagcctgattttcctcatcagtcaagtggcaacaatcatttaccttccctgactcccagggtggttgggagaatcaatgaaatgatgcacatgaaaaagctttgcaaattactaagggctatctatgtataagcatatgtgtgtgtgtgcatccaaacatacacaacctaaacataccccaaaatgaacatcaaattacagagaaagactgaagtctgttaagcaaatttctgctcatcttttatgatccagttgaaatgtccctgcttctatttatttgactcagtgcctaaaataattagcttgaatttttttttaaaaaaaagaatatagtcaaacaaaggaattgcacttatggcagagtggtgatcactgaacagtgagcaatgagactgaccaaggaagaaagcagttttgtgttttctatcccatcttcactgtggattatcaatgctcattgagtgtaacagtggtcataataacctaaccgcctaaatttctgtttctgtgtctcttgtctctcataaaaaatatataggttaattcatgcaaataaaatgcacatttgataggactctactcttacaaaatgcttcatgtatctgtcctatgaactggagtttctcataagattctatttagaccaatgactccctgctaaaattgttgatggactatgtctctcagcaacaggagggtgactttggagtgtgttgtatccaaaagctgagcagcagaaagggggagttagatgagatggtatggactatgtaagtgctcagagggcaagagggtagagacaactcctctcctcccacagaccagcaaaggcagcagtggtactcagctgtctgccaccagcctgaaaagggagcctcaggcagggacagattgtgtttgggttggagggtaagagtaataactcagcagagacaatacagacgtgcttggcatattcggaccaccttaccaagatctcccctcccatttctcctccacgcctctccagcgccagctaatccctcctgaaccggccatgtgtctcctaccgtgctgaacagatgctcaacagcagctagaaggaaacccagtggaggcaaacacactcatctttctaaactaaaatcccactttccaaatatcagaacggacaggaactcagagatcttaaggttagctgacattgttaggattatcactgcttttgtacactttcctttgaaaaattttaattggaaattcatttctgaataaagccataaaagaggcgctgctccagtctaaatggaggttgggggtctgaaatctctagagctccgtggagcagagctagaaaaaaggactctttcattctgcacaagggaatgtcaaggctgagagaggatgagagccttttctaggtcaggcacgattagtggcagagccaggactagaacctggccccttggtggccatttcaaggtgtgtttccattgtcagactcaagacagaaagctgtttaaaggtgatccatatatcagcgatttcaagggttttaggtaagcaatcggtgtctgctgttttagtgtatttaaagaaggataaggctgggcgcagtggctcacgcctgtaatcccagcactttgggaggctgaggcaggtggatcacctgaggtcaggagttcgagaccagcctggccaacatggtgaaaccctgactctaccagaaataaaaaaattagctgagcatggtgacaggcacctgtaatctcagctactcagaaggctgaggcaggagaattgctggaacccaggaggcggaggttacagtaagctgagatcacaccatcgcactccagcccaggccaataacagcaagactctgtctcaattaaaaaaaaaaaaaggcggggggaggataaaattttattttccaagcccctattgcatgtcatttattggtattgacaaattgaatgcattattaaaacaaatcaatcctcattggaaatctgtgaggtcagtgttaacatacccattttgcagataagaaaacaaaaaggttaaacaatttgctccgggtcacgaaattaatctgtagcagccctattattagaacccagacctctaagactcagaaaatcatcctgctctccagaaaaaatgtcctctcatctgaaagtgtattactgtaactacaagcaaacaatgtaaaataaactactactacaacaaaatggcatttgcacagtccttaggtttaaaagcctttcccttcattagtacctcatttgagcagctctgtatcacatggctgggtctaggatgaggcaagtgggtacttgtcttgtatgcaaaatttaaaggggttcaaaaacctcagtaatgaagataatatttcaatgcaactcttttttttttaaatacaagttaatgcattcctgagtttataggcaaccctttaaattctacgtccaaggtgagtgaggcactcatattctttgctggtcctagccctacagtttgcagacctgtgaaacagggagaaaacatattttcataccaattgtgcagatgaggaaagtgaatctcagatacattaaataacattttcagagaactaaaggcaggtctttctgacttgagctcagaggcctggagttcatcttaatccaaatccagctgtggctctctcaaccctgggaatctggtgacataggtatgttggggtagggaatagagctaagtagcattatactcaccagaaaactgaggcacattcaccaaatgagttatccaagacccatggctactgtgcaacagagctcggaaataaactcggatggaactccacactcaatactgccttccatcattaccaaaacacgaggactaaaatgttcttgaataatacacaaaaattctgaggtgctgcatgaatccacagtcagccacagtcctggaacagtactaagtgggctctgtgattgctaccatcatggggaggtcccaaaggcttcatccctgggccagagggagtgagatggagagaagctggcagtagatgggcattggaaaaaatgccacactatagattggttggaaacttgttcaaaaaaaatgtgataagcaatgaagagggagctcagggtgggatgtaggaccccaggggctggcagtgacatgtgattctccttctgtgctggactgtagggtccatgagggtagcggtgtttctgctctcaagcgcctgaaatagtgtcagtctcatactaattgctcagtaatgaatggatggatggatagatggatggacagaacactttaagttcaatagagcatggtgagccccatttcctaaatctgactcccagctctaccattgatcccatgcaaagggtatcctctctctgctttagttttctcacctataaaatgaacacaataattctatgtaattcatagggatgttgtaaaagtaaggtaatatatgtcaagtcctagttatagcgtctaacacctagtaaatgctacataaatattagctatgatccgtaaagcaacagtaaagggagttatcccagaaatgcaaaaaatatagggatagttgttattttgtgttgtgtacctgacattagtccaggtccaattgccagtctcagattataaaatgtggaacaatgccaggatcacagagtgggtgagactaccattcttttggcattttctatctgccagcccctgccctacccacttagagtatattattttacttaatccttaagacatgcttctgaaatattaggttggagcaaaagtaattgtgattttgccattacgttcaatgacaaaaaacgcaattacttttgcaccaacctaatagtttctattattatctatttttttttataggtaaggacactgagtctcagaaatattagaatatttggtcaaggttgttggaagcaggtctgagttcttgccctccggcccagggatgaagcctttgggacctccccatggtggtagcaatcacagagcccagttagtactgttccaggactgtggctgactgtggattcatgcagcaccttagaatttttgtgtattattcaagaacccaacaactctggaggctgagttcttcttttgagacagagttttgctcagttgcccagcctggagtgcaatggtgtgatctcagctcactgtaacctccacctcccaggttcaagcaattctcttgcctcagcctcccgagtagctgggactacaggtgcatgccatcacgccccgctaattttttctatttttagtagagacaggatttcactgacttagccaggatggtctcgatctcctgaacttgtgatctgctcaccttggcctctcaaagtgctgggattacaggcatgagccaccacactcagccgaggttgagttctgcctgtgtgccatgtgtgccatgctcacagtgtttcacttcactctacctcccagtgggcccaggccccatctggaaagggaggagtcagagaggagatgctggtgctgggtgcttcctccctcctactcatagatggctgctgctctcaggctagctcaactccctggagacacacagttgtctttcccaaggaggctgacactggggctgccattggtcatagctgagggaaggtgacacaagtgatgctgcacagtgaaatccaccatctcatgtagctccaattgcaacctggctccctagaaggaggggagaggctgttttaataatgatacccctgctccttgtggcgggaaggaaggaagggcaaagacccacttgtggaggctcaggctttcctgagctctgtgcactggctctcctggctcccggggatttctttaggtcctttggtttagccatgggtgtctacagccacaggaaaagagtgggtcccctctgcactcaatggggatagtgagatgtcagggatataggtaaccgagacagaattcaaacccaggtcagctcaactccaggaggctaataagtgacgttggtcaagtccttgcccatttcaaagctttggttttcctatctacaaaggagaggattgtaccagatgatctccaagggtcctcccagtgctgaacctgttatgaatgtgtatactgataaatccaaggccaacagctctggctctggcccaggctatgggtgaatctcctccacaaagctcttctcagttggccctcctttcattgagcaccttcagtgatgagaaactgattattccttgatgatggagcaacctggggagaattttggatgtcactgactttcactgactagttgcttgacttcagagagtggactcttctctgattctcagtttaatcatcagagaaacatgaatgttggtgcctagctccagtgaccgctataaagattaagttggctagtaagtgtgtgtgaagtttctggcacccaataacaccccaacagtaattttctccaagttgcaaggtatcaccctgccaagtagaaataaacaagcaaaaatgggtggagggaaataatgctctgtttacatgcagatattaaaatatttccagtctttctcagctataagatattccaccacacccaaggatcagccaggcagcatgttcttctttgcagaactttagatgcattacttcatcaatgtaaaaactcaggcccagagagtttatctgccttgtccaaggtcacacagaaaatcagcagtggattcagattcctgaatcccaagcttgtcatttcttcatttggggaaccaagaggccctgccacccttggctgacagcatcatccccttagcaaaaggcagctctgagtccctgcaacaaatgtaagcagtgtctcctaagcatctccaaatgccaggcattgggctaggcacctgaagcacagaaatgaataagaagtggccccctcctccccagaggattacaagttggggagagacaacaggaggaggtggtaaaacctgtccacatgtttctataataggatcttcatcactccattattccccttctctctctataaaagcccagagaagcaggcagatgttggcaacatctgggccactgttgtcggggcagcaagtggctttgggctgccattggagaaaagaagctgttggtgttaagaataataataaagagctaacatttgcatggtgtttactcctgtttcaagggataacccccctccatcccatccccattcattagcccaagcaatgcagacagcagctctctgaaagcctaggagaaccatttccatttctttgaaggcaaagccaaggctcacagaagttaaacttcctgcttaaatcacagagctcataggagagtgcaggcccaaacataaaagccccatgactcctagattggtgttcattccatatgccaggctcaggcatgcaagtgaatgcaaaaagataggtggtcctttctctaaacataaagaaagcatttgctgtgtgtttactaggtaccaggaatggcattgtgtggttagtatgcttaactcctttaactcttccaacactatgagataagcattccagatgttccttgacctacaatgggtgttacatctgataaacccattttatgtcaaaaacatcataaattgaaaatgcattcattaccccaataaagccatcataaagttgaaaatttagaagtcaaccatagtaagtcaggggccatttgtagtttcatacttttttaaaataaatacagaagttgagattgagagagtttaagtaatctgtctatggtcacactggtgactaagatgggtcactggtaaagtgggtggttcagtgacgtggtgagaagagttgggataccatgttccttgtcctgtcttcctcataaatttgtgacactcttggtaagtggcaaagctgagatttgaatcccaaaaacctgtcaactttgggtgtgactgtgtgtgtgacagcggaagggaacgaggatggttgaaaaaggaggaactgagccttgaataggattcttccaggataaagaacaacagcacattgcaagctgaagcaatgctttcaatgggttacacttggcatgccaaacataaggttggtatgactggagcagagtaagaaaggggacaggagaaagacataagattagggaggtaccacaaagccagatagcagagaaccaagacaccagacggtgagaataattaagtgcgggtactataaattcagaacagacactggagctaccccatagataaaccttctaacagacctgcccttcagtcttcctctgtcttcagctatgtgggccagtttttctccttaatagggatctctgaaagtgtttcctgaggttttccaatcctcattttgtagatggagtctaaagcccaaagaatttgcccagactcacatagcatatggggggcttgacttaggacctaagccatgctttctgcagactctttttcacactccacaccttatgttctcggcactcattttctgcatattttgaaattttagcataaggctcacactctctcaatgactgtctgagtcctgaggtttacaatcctcctttccatctgagcctttctgggcttcctctttgtccatcgtagaagagccactcaagatgagagggagaaaaggacaattctctctatgccagctgctctttccaagcctaaggccattcaaagctagtgggaccattcgctctgacagtaactgagacaaataaacaaaactccactgaggtgaatctgtccttttgatgcttttcagagttgacacagtagctcctcggagtcggcatgactcatgagttctttctaatggattagtttgggttcatttttagctagaagaaaatttgacaactgcactcctgaaaaccaggagtaccttctaaaggatccatctggtttcattcaagttagaggtcattttgacatttatatcagtgcaagcagggagaatcttctgaagtaggaggcctaaacacaaagacctatagagcagcatttcccaacctttttggcaccaggcactggtttcgtggaagaaaatttttccatggacttatggggggcctgtggttacggaataaaactgttccacctcagatcatcaggcatgagttggattctcacagggagtgtgcaacctagatcccttgaatgtgcagttcacaataggattcgtggtcctatgagaatctaatgctgttgctgatctgacaggaggcagagctcaggcagaaatgctcattcgcccaccagtggctcaaatcatgtggttcctaacaggccacagactgtactggtccacagccctgggtttggggaccacttctgtaaagcacataaatggggacttgagtagggtatcatagcagacaagattagggagtggtagggactgtggcaaattagagaacatgtgatccttctaaagaagtatctgctactgaaattcagccaattgtcaccatccaaaaatgcagactgagtagaacgtgcaagttacccccccccacacacacacacaccacacacccctatattttcatatgaaatttgacagtgaaaactttctttggcaagtcttttttttttttttttttttttttttttttagctgagtggcccaattgcagacaaaatgagactcatctgtggcctagatatggacttgggctcccagtttacaacctctgtcctatggggtccaattagtttcatttaacgtggagcttactttgacattcacattactataaatcctcttagagagtgtttcctatttggaatggttcccctggacatagcctacatcctcccaagcattcctatacattgctgggctgaaaattggcaagtttccacctagaggctataacctataaatatatctcaaacctccattccttttacactctgctggtggatataattgagtttctccctgtaccaaatgagctctgagttcttagtacttgatgtacttaatagaggaaagtcgggacgagtctggaaaagcaaggataacacagaaacagaacagggatatgctggctggaagcatcctaatggttttatcatccactgttagaagagaaaagcataatagtataactatcacaccctctgcataataaatgccttatggcaccctggccagcacatatacatatgggtggccttggagacatcatggagggtttagccactgctaccagtctattctcaagaggaagcaagtgggcctaagcatgactggagatgatgtttggtagaaaaacctgctgttccagaggcatgataagaagacttccctaagggagtcccttgatacatattatgtggtccccactggtgtgtggaaccaatcaagtaccctgggagctgcccagagcaaaagtgtgttttggaatcccacagggaactccactctgtgtgtcaccctctgtgtggttctgcaggaaggacactaaactatagccttccagtttgcttgttgattcctgcattctttcatttattcattcattcaataaatattaagtaattaatcatcatcgccatcgtcatcatcatcatcaccataattgttgttgtaatttattaagagtcttccatttttcaggcactttgcatttgcatagataatttccttcaattctttttgcaagaaacatattgctattcttctttcctaataaggaaactgaggcttagcaaggtcatgtgatatggacaaagttgcatagctaagaagtggcagagctgaggagtgatactatgttgtctaactctcgctgtggttttctcactacaaaacactgtctaataattgtatagtactttgttgtgtctcagaaagtaattatttaattctcataactgagaacagactgaattagacttattttacagaagggaaactgagtatcaaacaggttaaccaacttgcctgaggccacccagcaattaagctggtctcaagcataggtcttctcactgcaagtacagaatcgtttaaaataggatataatattcatgtttacaattccttcagtgataatgacaaccattaataatcctggaagttattaattactgatgcctcactatgtaccggaagccctgctaagtgttttattggaattcactcacttaatcctcataactatcctacaaggtcagtgtgactactaccatcataacgtcacttggctcgaagaattaaatgaaggttgcccaagctaggcagctagaaaatagcagagcaggcattaatagcaggtttatctgatccttatttccaactaaaattcttaaccccgccacccctccccatgatgtacagggcaggccttgggaaggataataaagcacattcagacccagacactgtcagatacttcaaggtggctacccaatatgcatttccctttcttccttagtaccagcccatgcttagtacctaaccatgatatggttagtttttgtgtccccaccaaatcatatcttgaattgtaatccccctaatccccacatgtctagggagagacctggtaggatgtgaatcatgggggcagtgtcccccactcactatcatgagctgttctcatgatagtgagtgagttctcatgagatatgatggttttataagcatctgacagttcctccttcacacactcatgctctctctcacctgccaccatgtaagacgtgcctcttccactttggccatgattgcaagtttgctgatgcctccccagtcatgcagaattgtgagtcaattaaaattccctttttaaataaattaccctgttttgggtactttgttatagcagtgtgagaacagtctaatacagtacacctgtaactaacaactacatctcagtcaggtggctatattctggccactgagatgtacatatacatactaggagaaaagctccttaaaggcaactgcctcatctgggaggtgtgccttattatcgatttatttttctctcccttcctgttgtttgagtagtgaacatgataactgattttcctacaattatcttagaccatgtgagtctaaggatgatccacatggtcttatcttagaacagtggggaaggaaggaaggaaggtaggacagtggggaaggaaggaaggaagggagggagggagggagggagggagggagggaggagagggagggagggaagagagggagggatggaggaaggaagtagggaagggagtgagagatggatggatggaaggacagaaggaaggagagaaggagaaaggaaggagaaagggagggaaggagggagtgagggagggaaggagggagggagggagagagggaaggagggaaggagggatagagggaaggagagagggagggaggaaggaaagatggctggcttaggtccttgaagacactgtgaagctgctataccattccaagctctcctatcatcaacgtgagagaaaaataaatttcattttgtttaatgcacgattattttgacttttttcagttatatgtaggcagatctaatgtcaatgaatacagacctgccctcaagtagctcacagtcccgtagagaagatgaatatgcagcagacatatcatgatacaagtagaaggtggctaaagcattgaacaaaactaaaaaaaagagctcgattcatcctccgtggcctccacggtaatgaccctgacagcaaaatccacaggccagggcatgctctctgtgtaatggcaatggataagctgtctgttctgaaagacgaatgcatccatttcaattagatgtgcccagtgctacgattgtaaccaattaatcctgcccatctgaaggctgattagtcggaatatttgggtgaatggataataacaggctaataagcctgctatccaaatgctgccacacgtcttttttgacacaatattgtggatgcatttgcagcatctgtgactaatcttcaagtggcgggaggcccagtttgcaaagcggcacagggacagggctcagggctgctggagtctcagcagacagagcctactccatctagtcctcaattgtgtgtttggatccaggcacccagactcttcctctaatgacatccttctgcttcctgaaaggtggagacccacattgcaggcacggaggctgggtgcagggccaggaggcagaaggtctcagtttcaggtttcaggcacaccctgaatgcactgggtgattcaatcatgtctctttccctctatagttttttaatttcctcatttgtactactcaccataatcccgaaacagtcttacttctgccccctggtatctgctcaccatctccttgcctagtacattctttcccactactctttgcctagctaattccttcccattctttaggtctctgctctttaggtcctattctttaggtctctgctgccttctggaaaccttctccagccactctttgcctaggtctctgggctacatagaatcctgtgtttcatgtattttaatgaatattgcatgagtatttactagtccacttcccccattcaactccaagcttcatgatgacaaagaccacgtctacttgcttacaactatgtccctgatgcgtggcatagtgcatggcacagacaagacaaaataacatgttttctaaagccttgttctccccatttcactgaactaagaggcaaaaggaatctggaattgaaaacaaacaaaaaaaagccttgcaaacctctaaattgatacacaaatgtgaggaattaggagtaatgaaaaagtccttgaaggtacagaaagaagcaattcaattcttgcaagagattcacacttgctcaatgtgtcaccaataattactctagcttttccttccctcatttgttgtaattaagacatagtgttttcattaggggagaaaccaaggcctagagcaacagaaattatgcacagtgcaaatcctggcaccatggcaaactagttgtgtggacgaggagaagccatgcaactccgctgagtctcagtgtcctctctgtacaatggaatgaaaatctccactgcagagctcataggtggctgtgagaatcaaacagttaatgtgtataaaatgacttgtaatttgtaaaatgctgtaaaattgtccattcaataacttcctgctggcatctctcccaaaaagacagtggaactcggatttcccatccctaaattctggggaagaggacagaggttaaaggagagtatggggtgtctgatgcatttcttcacttaattcactaaatatttactgagcatctagggggtacaaggtgctgtgccagaaaataggaaacaagaggtaaataaagtgtgcccttatttcaaagtccttctagtctggaggttagggggtgaaatgggcaagcaggtgaaccagtaatcaccaaaggacagggtgtatctgcaaaactatgagctcctagaatggagggatggtggataccagccctggggtgattattcagacctgacccagaagcaacatctggaatagttgaaggtccatggattctatcttgtgagggattttgaacagaaaagcaactagtttcaatttaccagttgaaaaaagattctggaggcaggcaaggagccaaaagcactgaggagggagatcacggcaggcagctaagtggagtctatccagaattttgtagagaagaatggaaaaagaaaaatcataacagaacaagagagaaaagtaagagggactcaggaaagaatattaattgaaagtgtgaggaaagaatgtctaataagaaacttgtaaagataaagacaaaagaagccaggattagcggcttgcctccttaacttagggtcttttgaggctatctgctgccaataccatttgtcacccaggctgccctcctggcagtagaacagaaacctgtctaaagcagccccatcattgatgaagtccccaggaatgggagacagctcagacatggattctgattctgggagtggtgtgtccccactgagtagcctctctcatctgcagttccttcatttgtaataagagggcagcaacacccacttcacaggagcaagagtcttgagtatgggatgatttgtcccaaatacagtcctcgaataaaacttagtttctgctgtattgagaataaaattaaaaacaaaaacaaaaacaaaaactgtcatccagcaccagcagctccttcctcacagtggaggctgcaatgtggtgacaggcccacagcccacacctctaagaggttcatcctgagatctggctctgcttcccttctggaaagaaacaaaatgcttcatttctgaagatggaggagagggagaaggctgtgtcagctccttttcctagaggtgctgggcacctggcacatggcactggggtgcagcaggtgcttgcaagacatgactcatatatgtgcctgttagtagtgacaatccctttattggtatgaagcatggctcatgaagccctttaacacgctgtgtctcattagtacctctcagcgacccctgcacagtgatctttttattcttagcctccaacagacaatgaaaatgaggcccagaggtaatcaggtgtattcacagacactatggtgtgaaagtctatttaccgaacactgtcatgtgtcagtcaacgccccagcctctggcagaagaatgagatatagtctctgatctcaaaacatttcccatcctgtagagctatagacaggaggaagggtaccttgtctacatcaagtgaagtgttatggtggaaggaagcttcgaatggtgagtacacacttaggatgcttatgaaattcaaatagcaaggacaaaggccatagtggattcttggagaagctgaaatgtgagttgagtcaacagtagctacttgcttaagtggaatcgaataaaaagaggagtgacagctccagttagaggaaatagaatgaggaaagaccttccagtgaaaacatcatgaagtatcttccatgctacgcaaagttcacaatgtctagtgcatacaatataaggctgggagtggcagaattgcattgtttggatcctagagagacttacaagtgaggccatggagttaggtcaatccttaagggaatggaaaccatggtaactttccaaatgtgtgctcagtgactaggctggaaccgcaatactgttggacaatgacaagacaggtctatgtcagtggcacctttctagagacagaagcaaagtctgtagtttctgcacagtttgtgctatcatgtgtttgatcaaaaagcagaagggtggcatatagtgcaaaccccaaacaccccatctggaaaaggtaaaggacatgtaggagatggtgccaatcatctacttttaaatacaaggtcagaaactctcatgccctttgtgcaacacccagtgttgtgtttctcagacttcatcaaggctggatggactatcgggctgcctcactgctgatgatgaggttcggggcaagtctcttcactctccaggcctcaatttccacatatgtacaatgggatgattgagccagtggctctttgtgctcgcttctacctttggcatgtgacaagtcttgctttctaataaatttttcagtgagtatttaaaacacctgttctcctgagcaactcctgtaagtcacatttgcaagggaaggaaagaacatagctgtggcttgataacccataactgctgaagtcgtatgaagttcttcaagtagctacttggagagaagaagaaagaaaaacaaggcaataaaccctaatggaaaagaaggaaaagaaaaggatccacgggaaatctgttctccccagtcttaaatctcaaagtcacggtgaatgctggcagcatctctctgtcctttctgtttaatctcacatcttcctccctgcaacctgtcctctttccttcctcaattgagtacttaaaagtgaaggctttattttcactctgattctcctttcacagattgtgcaaactggaaaaccatttaagatcattttgcccagaggttttcaaactttattttgtagcagaaccctttgttcaaatgaaattttacactcaaaggccaacatataaaatttataaaaggaaagttcctctaagcatgacgatcgaaggccatgcatgtggttcctctcttcacccaccaccttccccctggtcttgaggcacccccacagatccctcaggtcccaaggagcatgacatgaaaaccactgacattgtcttttttttttttaactttaaagatggagaggctgaaatccagatttaagagggcacttattcaagccgtattactggaagtcaacagagttggagccagaattcaggtctctggggtcccagggtaacacctatgcccttatcctgttgccttctttgtcccaatctgttgagacctcagtctcaagggccttctaagtggcattctccccagaaaatgtcaccgcctactcatctcctctctccctttctttagaaactcactaaccgcccactctgagtgctagttctgctgtttggaagcacatgtatcagcttcacctgatgtggcagacatattctctaagcctggggcttttccattgcccactgcccccgcagggacttcttaatccaggtggaatcagaaggcttcttatgaatttcatttcatttcaacacacacacccacacacccacacccatagtctttagtgatgcagacataggaactggcagaaccagcaatgaatgtgctaggcatcagaagactgggtttgagtgctggtccaattcttttcaacctctttgatcctgttagacacatttctttgcccattgaggcccctgccctcctacttcacaagttagtgttgaagatcaaataagataatgaagacagaaggactgataacctataaagtagtttatacatgtaaggaatgattttctttggtaaatttctcatcatttcccttgggcaggataatttttatcagttaatccctaaaacctatttccaattatctgttaatttattaatggatagttttagaaaaatatttttctaaccattatttgatcttgccttctaccaaaaccattcatttattaattcattaattccataaacaccaatgaagcacctactattaggttggtacaaaagtaatcatggcttttgccatgactttaatggcaaaaaacagcaattacttttgcaccaacctaatatttgccaaaacactggctccattggtctcataaagtccaaggtctcatgagaaacacagatactgtcattcctgtggacagtgcttcaaatggggaaacacagactgagagaagcatatgggagtgtgtactctagcctggggtgaaaggtccccaagggcttctaggaggaagtaatatctctgctaatatctgaaggttgagttggagtgatctgatgaagtgggtgaggataagacaggaaaaccctgagtcacccagaagaagggaagagcaggtggaacaaggctgcaagtagttcagaagggctgaagcagggagggcgtggccacaggtgaggctgaatcaagaacaagaaggagtgggagcgcaaatggttctatgagtgaagctgaggagtcagcactatgacagcatcctcgctttgcagaggagaagctgagaaccacagagatgaagttacttgctcaaggtcacaaatggaaagcaacagagatggaaggtcaatcctcagctctgtccctctgcctggagccctctactcagatacctctgtggcttgttcacttccttataccattcataacttcaaacaaatgctattttttttttttaggtaatgctttgtgcgacaccctttaaaaaaatagaaccacctgtcattctctatcccattaccctacttcatttttgtctcatgatacttattataaatatggtaatttaatataatataaatttatctatttgtgctttgtcctcttctttgaaaaaaacataagcttcatgaggacaggaatttcattctattcatgttgtctacctggtgattataacagcactgagcacatggcaggaactcaataaacactaaatgaatatgtacctgaataaatgaatttcaacctatctaaagcccttgctatgatactcaagttatatttctgtgagtgatggggagtttctaatcttttagctgctattagcaggagaataacatgatagaatctggctttagaaagttcacactggtagcattgtgaatgatgaatcagagagaggcaaacctggaggccaggacagtgaaaggcatcagtactaattcttgccagggaagatgatagtgtaagattgtctacactaggtagtcataagagggatggagaagagagtcttctaaaaagcctgaagcctcaggcagactatcagcacaggaattgggagctcactaagagaagaggtcataaaaggaaaaacacatctccaaggaggcaaaactgttctcatttctaaatattatgcccaaaagtggctagaatagtctgtcaaattaaattccttcagaacaacctctgataaaattatattctctataggttggagaagaggtgtctttggaagacgataaaggagatttttgcattgcctaataatgatggggatgaatgtcttaatcaaatggagatcaaggccaggctcatttgataaagaggccagtttctctgagaagatagagcctgagcaccaagggacagtaggatgcccccgaaagtgaattcttcctccttgctttgtgcatatgcatgcttatctgtggccagaactctggaggcaaaactaaaaggtggtggtttctgttctgacaaagcctggacagaaactaagaagatgctgcaagtaactaatttgattgcatccattcatttccctcgttcattcatttaatcaaccagtccaccagggggtcttcagctaatacttgctgatattctcaaagtgccagacacgcactaccaccaaggacagagcaagaaacaggacagatccaggctctgtccacatggtgctaatggcccagtgtctcccaactatgttctttgcacaaggtcattaaattaaaaaaacaaatcgttatgttgttagagtgttttatatttgccagggactagatatgtcttgtactatttaatcagcaattctatgaggcagttatcatcaccctcatttgtcaaataaagaagctgaagctcagtgaggtttaggaatttgcagaatgatgcagcctgagatgtgggaacatgtatttaaacccacgtcaagattttgccaaagccctttttccattctctgcagcctcttacctttgcagaaattgggctccaaagtcagataaccttggagtgaatcctggcttcacaagaatgtgcacttcagatggtgcctggctctcagtaagtgctatactatgttatatgttgttgttgctgttattactaattaggcaagctcttcatctcagagtcatagcatcctctgtgaaatgggaccactaatgcattatggaattttgatgagaattatgaagatttaaatagatgatgtagattgtgtccattttcctgtctgatatattgggcagtcattggtggcaaggtcagagcccctggtcataccatgactgagaggcatgactgcatctctggaggcctggtcccaggagagatcccttgataaggcttttcttcctctccacacctgggtccatttgttcaaaggggctacagtgatctcccagatctgttcttatatctcttgtttctcttcagcatggggagtaaagcagaggagcaaaggaggtgctgggtcatgaggccaagaatagcaatgccctctggaatgccctgaggcaaacagagctccaggctagggaccaatcccagagacatttccttggccaccaccaaggctgtcttcctcctactggaaagcttccccaagataaaaaacgagctggtatggcaggaatccagcaactctagtggagctggacattgtgacaaaagcaagggagggacatccatttagtgaggactttctgtgccgggcctttgcctccttctttgcctgtccccaccattcttattctcatcacatctctaaaacaagcagggattacctgctccatttaagaacaaggaaatggaagccagagaattacagcagttgccggcagtcgctgtccctctgaccaggcaatatctgatggtgtcaaagcatccatgaaacaggagctggggcagaattgtggggaggatgggcctacgataacctcttgtcctagaatgaagctgaggtcagcctcaggactactggcctcggaaatgcagtagcctgagcagctcctatgccttatttcttccaccccattttggccacacacccagaggttcttatctgcatgaagtgccagcaccaggaagcctttctgagtctgaacgctcacaggcctgcctacctccccagccctgaacagcatcccgacaggctgggagagcttggaactctggagtctggcaggggaggtgaaggtgaaggttccaacgccagctttgcttttactgagatttacttccttgggcaaatgactccaactatgcgagcctcagatttttccatctgtcaaatggggccaataataggtaccatagaatgatggtatgagaaataaatgataagatgtattgaagcacatggtgagcattcactaaatgatggtcatagagtcaaaatgataaaggctatcatttattgaggatttactacctgccagacccagttctaaatgtttgtgtagtgattaatatccttaagtagcatttatcattattattgatacattttcttaaattcaacatacgtttcatctaccacacttctgtaaagactactacaacccaacccagggtttccttggcaatttgatttgaccaacagctcctgagcacctctgaagggtgagacccagggttagacaatggtgagacacaaatggggatcgtttatggtttctgctgtgggtaggaagcttagtgtcaacttaagcaataaaacaggggcacagttgactaccataacataaagcagtggcatttaaattatgtcccattggggcccacaataataaatacagacagttgtatatatgtgtatatatgtatgtaattaactaaaattttttcacatcaaaaaatactagatgtgagtcaaggtgttccattctggtttattctattttggtacattctgttccattccactctattccatatcactgtctattctgttcgattacacattttattctattcagtcctttctgttcctttccattccattctattttttatgccctcttctatttttcttaaaaaggcttgctgtgagccagtaaatatttcaggacttattaaattgtttcaacccatctttcaaaaagtactgatataaagaagctgttttccagttagttgcagcgaagaacatctaaattaaatcctacctaatcctagtatatgaaacacaaataatcacagttcttctggctgaagaggtgttgggggtccagaaccaactgtttggtgacttattccattctgggcatccagaaatcagtgaggactatttagagttgacattaattataaacagccccctctggacttccagagagagtgcttcagagaaaggatggaagggagatcatttaaatttgtaatgcattctgtatatttatcggatgcctactgtatgtcaggtcttgaactagggctgagatacggcagcaaacaagatgcatttcaccctcattaaggggatactgaatgcctaccatgtgctaaagcaccttacacacagaagcacttttaacccacactgttcccttgggagattatttgtgttacacccattttacagataaagaaacaggctcacaaatagcctaaggtcatacattgatgaatgttagagctgtgatgtaaacttgggttgattaaactgcaggttctttacttctaactgggacaatattcgaaaggctcagagaggaggtggtttctgagatgaatctacctgtagaggtgaaggagagtcttccccccatccctcaagaaacagaatggtgtgagaaaagtacagaaagaagattgaggatgaaacaaatgccgggagaacacggaggagacatatttggctggaacacagaatgtatgacaaagagaattgcaatggctattgcaagcgatgcagaacacagggaggggaggaggaagaaggctcagctctctctagagaagctttctagaagccaccggggcaagtaccacaatgaagggcatgttggacaggtctctgttggaaatggagcatcaacttcaatgtggaaaggtacaacttatggcaggaaaacttacttctttgaaagcacacatctagagataatcatctatccaagggaaaagcaaatttggtctgaatgaaaatgatgtccacaagaataaaatcctttcacttggatcactaacaaaacactgcctcgttttcaatgcatttgaggctcacaccaagcctgcaagtttggcagggcagagatgactgttttctctgtttgatgatgcggaatggggagtgggaaggagttgcagagctcaactcatgttcagcctcacccaggactcgccttataccctgtgcttcctcctcctatgctttccagagaacctgctcctcttttgttcagaggctgctgggaaagtagggtagcacatacactaaatgctggaatcctggggcatctgcagctggtgcagtcctcagaaatgccactctgagggtggacagagaataaagggacctagtgtttatcagattttactatatctcacacatattggataatgcttcctatcatggaacgttatcattggttaggcactaaggttcccatcttaaaggtaaagcaagtgaggcttagagagattaaaacagttgccaagatcatacaatcaatgactagaagaggctggacttgaacttaggtttgtttataagcccatgttcatttcaccatatcatgatgtcccttgatgtaagatcaaataatggaaaatctagactacgttatagtagcataaataagaatacggaaaagggaaagaagaagaaataaaggaggaaaaagagaaattattaccattctttatcccatgactactacaattcccctactactattataactcagaccctctcaccttctaaattagtttttcattcaacagcatatttgattctcacaagaatgctgcaaaggacagaggacccactattttctatgcatttaagagatggggaaactgaagttcagagaggttaagaaattgttaaagacacagatagtcagttaaaaacctggaataaaatttgatccaaaagatgtttagctggaaaaaaaaaaggagacagaagaagacttggaatatttgaaagcattctttgaaatatttttgtagcacaacttatagaaaaaaacctccacatttttctatgggactcagtgcacatacacacaaagatacacaagcatcaaacgtttcagaaacaaacttgtccttactttctctattttgttctattctatttccatttgattttgatgaagaaaatgctggtcctgattcattaaatggatttactatcttactaatgggtctaaaaggactagagtttggggaacagggacacactgacttcggggctgcatgaaagctagcttaaaggatccaaagaactccaacatggaaggaaaagtagattcatgatccagcgctagagatgacacaactatgaccaaagagtagaaactgtgaacacagattttaggtcaatctggagaggtctttctaaataggcaaatctgttcaaaaatagaaagattgccctgtgaagtggtgagctccctggcactagagccatgcaagctgaagcttaaagatctcttgacagggctgctgtagaagaaattgaaggtgacctctaggtttctttctaggccagaaacattatttaatgtatttttctcattttctccccaggacagcagccaccacagaaaattttggctttgaagtgagaatcagaggacacagaggaaaaatagagatgctgaatgttggttccactgtcaagctggggaaatgatatatacctctctccattcccacaacataggagaaatgaggggcaaaacagcattccaggagtggactaaatgtataaaagaagagcaaaggaaatcggagaaaagaagagatttgttgtagtcattgctctgccctcttttccattgtgggacaaagggccagcctcagttttcccacctatacagtggggatactgttggactacatctgcaaggatgatttcagttttcaggttataggtttttttgttgttgttttattcctgggtccccttgtcactgctcaagatgccagcttggcagctgaggccagtaaaaagaagagtagggagtggtttagtctctccattggaaggaagaaggaaggaacgattgtggcccatctctatagccttgtgctgacttagagtgtctcatcccatcaaacgcatgggtcatgaagttcaattcattaattttggtggtggagggaggctgacagacttggtgctgacatgaataatgatgggtcaccgggagaggccccagcaaaacctgcagcttaatcagactcagagagtctctgcgggcattaatgtaggccaagtgctttccagccaatcagaccccatttcaatttaatgttgcaaattgttaccacgcagctcagcctctcaacgcacaactcagactcaaaagtgggttactcatctgttcccttttcctgttcatttggaaacacctccctgattattgtctgtgtgacagtttgcagcaaaggaggtggataaagtatggtggcaagaattcacaccgggttatgtaaggggagcgggtgtccctgctccatcactttctattcacatttctaaagccatgctttgcttgcttgtaaaggtctgctgtgtctccatcgcctgcaggataaaatccaagcctttatcatcaaaattctttagccttaccacccacagtgcttccccaggcattctctgccacagccacaacaaaccacttccactccctaaaacatgctgtgcccttgcatcttgaagcctccttgtgcttgcatatgttgtgccctctgtctgaaacgtctgccttagctcccctctgttttctctgcctcacctgtattttccagtgtcaccccagaaaaagacacaccaaagtagtagatcctgaagggatagggatcgtctatttcacttcttgcctagagtagatatacaaaggtagaataaatgaatgaaagaatcagtatataactttggccaagacatttcaagtttctgactcttctttttcttagatacaaaataataaaaatagctctttcacagatattattgtggccagtgacggaaggcttttcagcccttccaccctcccagtacctctgagagccttctttggatgaaattgtccatgtaagctcctgacctcaaaaatgctccccttagctcctggggcttcacctctctgtagctcaggtttctcagatgcaaaatgtgtgtactgaagcatgaatggttggaaagattaaaagcatgtattcactcatccctgctttcagtatatacaaccaatgtataagccaaaaataaaattctaaggcccccctcaaccatctgaatggacccctcctctcggccaagggcatttcaaagttaacctgaaaaactagttcaggccatgatgggaaggggaggtcagacatacctcattatgccctcctccctttgggaatttgggaaaaaccaaccagcattaacatcagcacagaccatagatctaataagaaacgtatacaatctgttttctctgaagcctgctacctagaggcttcatctgcattataaaaccttggtcatcataacccagacattcttttctattaataataactctttcaaccaattgccaatcagaacattttaaaatctacctatggcctagaagtccctgctttgagttgttctgcccttccagatcaaaccaatgtacatcttacatgtattgattgatgtattatgtctccctaaaatgtataaaagcaaactgtaccctgaccacttcggacacctgttgttaggaacccctgaggctgtgtcacaggcatgtccttaacctaggcaaaataaagattctaaattgattgagacctgtctcaagtactttgaggttcacagatgcaaattattaaaatgatgactgtgaaagtgactttaacagaataaggtacagagtaaatgctcaataaaagctttctacctctttaaaaatctcatatccttttttacttcctgtccttctttcttcttgctttcctttcttttatcccttactggccctgtcatctccctttttccccaaggtgtgattttggaattctcatgggcttggggagaggggatcaggtacagcctaacgttgcccctaaaaaccctgacacaacatcaaagctagccacccctttaacagagcacatgaatgcaatgcactaagaccacaatggcttcaccttcaccaactgctatatatactggactttgagttcctttgagcaatctgtcatgtgaacagagggcaaaagggttattattaattaagggaactgggaaccactgttattcttcttctaaaggtctaccatcaaaagtacatctcaccgttccactctatcctggataaataagtgccaagattgaggcaaggtctgaagcaatgtggtttcagttcccgtcctcacttcctggtaacaaacttcatgtgctttagtgcatacataaatcccctaaaacttatcaaaaaccatatacaatcaagaatcgacaacctaccagctgtcaacaacagcaatggtgttgagaaaaatcaaaaggtcagaaattgtgatttctttatgtggtctttgaatgtagtcaccaagatgggaaagctgaaaggtccagatagttatactgtgtagggagtggtaagggagaagtcacatctccttactattaactaactgtgtgacctggagccatctatttctctctgaactttagctttctctgttgtggaatgagtctggttcagtttaacaaaacccaataggcacataccatgtacctcccaggcatgaagctaggcacagacacattgacaaataatatatagcttaaattgacggggaagactgaatttgaaagtactccatacaactgaaaagtatgctacacaaatactccataactcttttgtgaaagtgtgtataagtatgtatctgtttatgtaaacatgaattattccagtgaataaattgtaaagtgaagacattatgctcagtacatgtatctgatataaattaatcaatagtcttgcatgaatgagatgttattagaataacactaaagacagagcagtgagcacaatgaattccctgctttcatgaagatcacatggtagtaataagaaagtcacatttgaggggatgaaagacaacagaagatccctgggcattttcactcagttttggcagcataattagtgggaaacctttgtttacaaatagagactaggcaagttgagggtgtgtaattcagcagaaattgggccaagaagtaggatgaccatgtgctgattcaggacctgacagcaccatgcctagtaaatgctttaggtgttgcataggcagcagatctgttcaatctgacctggatttaaataagtttacacagcttcaaagcacttggaacgtctgattccactttcatggctatgcttgaattcaccaggtgttatctctatcagcaaatgtttcttcaataaatgcccagccaagcctcctgcttgaacactgaagtctgaaacaaaagaatgttgaactccaaagtctgaaaaaaattaatatcacaccatttctcttaaaatgtctcccatgactctctcctcattcttacctctgctttctatctcctccaccatctgtagccctaaactgtgcatttgactggaaatgtatcactcaaggcacctgtggtggagtgaaattggttaggatttcatggtcccatccaatttcagctagcagcaggcaaggaggggaaatattcagttatgagcagtctcataccttttgcttttctcaaagcaaagtttgggaagaaggatcttttactgttgttgtttccactagagaactttgtccctttggaattattttgccaaagactgtgatagaatctattaagaagcatctttaaaactatacttattgggcaaggaagataatactctttattttaaaaaggtattatttcaattctctttctttctttttatcagcattatcctaatggcctctatcatttaggaatcagagaacgacataaacaaaagagtaaatctgagcctagtaatttccaggacttcacccaggaatagaggataaaatttataccattagcagggatcatcaattttttttggtggtaccagagtgtgggtatacgggagaaaggaggaggccacaccattaccatcacatgatcaagactgcaatttgtttttcctgtggttaggcagagccataagatacggtactcaaatgtaaggatatggaaaaacactttgtggttattaatttcatctcctacctaatactgaatattcccacccaacactgtggttgatattctgtttctttttttatttatttatttatttattttttatctccttagcatcctttccctcttcatttttaataaagacctagttttcctttgagaaactaaatgataccccttcaacaccctcaatccatgtagtctagatctggctggcctgagtctcagttcaggagtggccacctaacccagagttggccaactggagcattgcagtgaactttttagggtttgtattaacagcaggaaggataataacccccaaagatgtccaagtctttatactcagaacctgtgaatatgataggttacacggtgagggagaattaaggttgcagatggaattcaagttgcaaatcagctgatcttatcatgagagattatcctggattatcaagaaggacctaatgtaatcatagggtcctagtaaataaaagaggggcgcagaagagaaggtgggagtgttgtggtgtgagaagaactcgaccccctagtattggctttgcagatggaggaagggggccatgagccaaggaatatgagtggcttccagaagctggaaagggcaggaaatcatattctcccctaaagtctctaaagggatcacattgttgctgacaccttggttttaacccagtgaaacccattttaaatttctaaactacagaactgtaagatactaaatctgtgttgtttcaagcctctaaatttgtaaaactttacagcaatagaaaactactgcaggcatggacacatgagcaaattatagttcgcccagatactttggctaaaaataagaaggactcctttttttctctctttttccctaatgatactaaatataaagtaatcttatgaccgggagagattttgcccaaaaatgaaacctacccagaggaaaccagagtgaagtataactttgtgtgaacatttttatctaactattcctgaaattaaaagtagatatttcagtttctgggagaaataaaggccttatttgtcctttagccagtttgagttggatttatatcacctgcaaattctttaaaaaaatcctaccactggcatggtggaataaataccatttcttgaaatatcttattccaatgctggatacttttgctattatttcttttaaaaatagaactggaattggctatcgtatagcttcagtcattgattcttacgtcctgaggccacacaggacaattttaactcctatttcaccttgggagatactcgggaattgaagtagtgatcctcatcaagatcctcaaatcttcacttctccaggttaaatcctctcagttttttccagaattgtggtaatatggttttgaaccttttcactaccctgtggttaatcttccctggacacacttgatgttcacaacgtttttcttaaagataacactacaactgagcacagtattcaatgtagtgactattcaaatcagaacatcctgtcctcggtgggacacgtttattgatgaaatctaaattgaggctaggcacagtggctcatgcctggaatcccagcacattgggaggctgagacaggtggatcacttcagccctggagttcgagaccagcctgggcaacgcagcgaaatcccatctctaccaaagatacaaaaattagccaggcttatgacctggtctcaaaataaataaataaatatttaaaaataaaattaaaaaaagaaatctaaattgaaaaaaatacagtttatttatggtatccacataatactgttacttcacttagtttcttgtccagtaaaatctacaatttttttttctaggtgatactgagttatttctctggtccaatctctacatttaccccattcgtaaaaattatgtcttgatgtacatagagatctttagagttacatctactgaatttcattgcaaagagaagtggatagtgagtaaaatacaggatttgtattcagacaagtctggattcaaattctggctctaccactcatggctgcctgatgttgggcaactgcataatttctccaaatattagcttcctcgtgataaattactgtgccttcctcataccactgttatagaaataaataacataatgcatggaaaatgcttggtgtagtgcctggcatgtactaagctaccgaatatagcaccggttttatattcaatcagaaaaataaataggtcagagctttcaatcttacttccgaatatacaagaggaaaagttagggtgagagaggaataacaaaagagaaggagggagaaaataaaaacacaactggtcttccccatattctcggcttacatccaaagtcaaacacagctagtcttagaaaacaagatatccaaacttacttaatactggaagtgttaggcttaacgtttttgtttgcttgtttgcttttgaaaatgggacctggtaggtgggaagtaaaaacgttcccttagaacaaattagataaatacaaagaaatcacacacatagtggaggaatgaagatgtttgtaagttgatatttcggaaccaaacttcaggaaggaccttggcaacatctaagctgagatgttttcctcctataagtaagaaatgtaggctcagagaatgaaagcttttttctctgtttcaactagaaaatctcacagctagaagaagtcaaggtcatttttccccttctgagcccaaaatccctggtcaaaggggccatagaagaagtctatttaagtttgtctttctccagaagcagttcagaagataggaatttgactgtaagtggcttacttggaaagtgatttcagaaataactattagaggagttaggaaacaaggcagggaagaaaaagaaggccataaagaatagtttataaagccagatgccactgtgggcaacagaaggtgcattgtgctggggcattctgagaacaacagaaatgcctcggagatagcccactggagtggcaagggaggtgaggcatctgttaaccaactcccaacaatcagcagttaaggactgtgcttgaaggtccagtgattcccggcactgcagccttccccaggcatgggcagaggggtaccgagctgccaaagaacctctagccaaagagtcacatgtgctggcaactgaaagtcaagccagcattcatggagagggtcagtgttgagggcatgtgggctggacaccaagagtgtctgctataaaatccaagtggaaatgagacagaatctccaatccggcctaaatctgccaaccagcaatcaacaaactcaccaaccaattaagaaataattacagctactagctgtgctgatattctaatatgttaaagatacagaaagaacattcaagtgctttatcactccactgatgcaagtagtcacatcactacacaatggttcctcagaatcagaaaaaattgaaagcaaaatggtaaaaaaaaaaaaaaatctcctaatattttagtggataagaggtgggattatcgaatacccttaggccataaagaatagtttataaagccagatgccatgttaactcttgaatgctaattcctttctggaatatttcctataaaacttaatccttcaggaaccatctaaaaggccatctcttccataagatttgctctagtggtaaaatgagctaatctgctaggcttaactccctgtgacctacccagatccctaggttgtgccagacagatgcagtttatacacattcctgcacttcctcatccttgagcttcaaatcagacaggttttataattaagatattgtagaacctcactaaggattcaagctgctctaaatgactgcccaaagctaagggcacagccaagggaaacatctataactccctccctccctaaatgccatgggatccagtaataagcacgcctacaaagcaaaaaggaagcacacatgcaacagaaactcacaaacacacacacacaaaaacatacaaacaatctggttacaaaatatatcttcaccagcttctacaactagttgtattttaagatgaaatatgaaaaaaaaaattggcaagttaggtgttactgctccatgctgaccttttcctagtagagttaaaagagccaccatcaacattagaatgcgaaggttactgacagtgccatggagatgccaacttgaaagtccccatctcagaaaaagaccagcaaggctgctgagcatggtacgtcccttttctcctagataactacactgacccatgtctaccacctgcaaaaaaataagttgcctttaataagtgtgcattttttctccttcctttcatattttttgtaattattattttcgttttgctttaaaaatcacttttctccactagggtaataaatcactgaagacaagatcaactgatgaataataaaattagtgggtataaactttttagagaaacaagatatttgtagagcctcaaattatctcccccaaatgcttgttaattgctttagtggtctcaacaaatgttcacaaattatttgaagctttccttctaggaggtggatcttaatccccctcttcttgagcgtatgctggatttagtaatttgtttctaaataatagagtgtggaaagagagaaacagtaacttgagagtggagaaacctggcagccaccaccttgtacaagtcatcaagtacataattagtcggttgataccatgtaccaggatggaatgagaagagcacttcatctttgtggcattctttgtccaaatctggagaccctaaactaattccaaaaataaaaataaaaatcagacaaacccatatggagggacatcctacaaaatacctgaccagtgatcttcaaaggtgtcatgatattaaacaaagaaaggctgaggaggaggagaccatggagacatgagagctaaatatggtatcctggattggatcctagtacagtaaaagggcatcagtggagaaactggggaaataatagcaaggtctttagttaatagtgttgcaccctgggatcacttggtttaatctcatcacattagagacaggggaaagctcagaaagaagagacttgaccacagacactcagcagttcatttcttgttaatatctcagtacatacacatatactatgtttatgaaagatattaacactaggggaggctaggtaaagagtatttgggaattctctgtgccatctttgcaaagtttctgcaaatctaaaattatttccaagtaaaaaatcttaaaaaatgcaaaaacaaataaacatcaacaaaaaaattcctcctcccaatggtgtggttacaagccttggaatggggcacctaagagctggctcctgacttcagctcactctctgactttgttgatacctttgcctctcagggcgcagtttctccaacagtttcatgatgtttcatgatgaggggaggagcggggagtgatttagtagttttcaagccatgttccccagggcacagctttgatggtatgtggggtgaactgagaaactgaagtcctgctcctgcaactcctccgaacctccagccagagcagacccactttgttgttacatatcaggtgtctatgtggacataaacaatgccaatcattgcatttcatttgatgaatgtgtttcatttgataaatagtttctgctgtaaaatgttaaaaagcactggaatagattataaatgtggttcccttctaaacttactttcattaccaccctgccaagtctttcctgaattaactgagaatgacttaaacacactgttattttcctctttccctctcttgtccattagctttctgtgggtaaaagccatgtatgtccacctgcgttcatcagtccccagcccttgtcatgaaacagtggtcgatatcaggtgaattaatgttggatggaattcctggagtcaaataacctcttggaaaataagagggtatgggataaatccctgaccccagggacttaccagcatcatcttctgggaaaaagatcttaactaagagggagcagttgtaaattattgactgaagttcaaatccaaggcctgaaccaacgttttcttcctccaggaggctttccttaatcactctggctagaagtatactttttctcctctgtgttcccaccgtctaaggtctgtgcttctgatacagtgccatcttgtattccctgaatacatgactcaggaccctgacccaaaagtatgaaaaccttcatctgggaataaagattaagtgcttaacacaagaccttgtgcatataagatgttccagaaggttgaagaagcaaatgaacaagctccaggtcccttgtttcaagcgggtcaaaacaaagctctgacagatcggggtttgaaatctaactctgccagttcctacaatgtgacattagacaagctgtaatgtctctggggccccagtctcaagtctgtcactctagttaatactgctaataaactctgttgaccaaatcacaattccaggggtctaacaaaaaacttgacacatgctgagcgggttgttcaagaaatattagttgaataactaaattgtgacctttcagcttccttacccgtaaaatagcaatacgaatacctacttcgcatggctgtggtgaattaagtagcagagcataagacaagcaatcagcacaatgcctagtgcatgacaatggctcaataaatgtttgtttttcttctagtcttttcccatcaggtattctcgccagtgaggggactgacttaagtacttctcccagccatgtgtttcattatggaggccaaattaagaatccaaggtgcttacatttcagcaaaagacgctagaccacggagtgtggcatggggtgtaatgtattcacagtagctatgctaagaaaacatctaggcccccagttgagagactatggcagcatcattagcataacaggtgcctttgctagaagaatgacactttaaagacaaatttcccccaatgcatttccccaaacgcaagagtgcatatttaattacacttaatgccatcttctcctctatttctgcgcttgaaggggacacatcaccccacaaaattggggaggttttttatagaaatggctaggatccagaactgcttcttagctccagggcccaaaggaaaaatgtcaacaatggtgcttcggggaaggaaacatgggccttatttgtttgcttgaagaacatccagctgagacagaaaatgatggaaagagcagaacacactgggacctacgagagctgaggttcagcgtgggcaaggccccgtgcgaatcatcatcacagattatttttaatgctcacagcaaacaaaatggtgtaagtctagccatcattctaatttgcatacaaggaaactgaggtttagcagatatgaatagtttttccaaggttgcatagctagtgattgaggcacttaaagttgaaccaaggcccatgatttttttcctctttatctactgtcccaatggtttcacttttggggcacatactctgcaagaggcactgtgccacaaatttcatatacatcttatctcactgaatccacatgcccattggatagtatttttcctattttacagaaaagaaagccgtggctcaaaaagtgaattaatttgccctaaatcacaagtagaggtaataggaaatttgggatttaaacccaaatttgtccaccttttatcctcagtgtcacattactagctgtgcgagtttgaaggagtaaattttcatctctgggtattagtttttcttgtttaaaaaaatactttttatggtggtaagaaaacttaacatgagatcatgagatatactctctttacaaatgtttaaatgtacaacacataatagtttgctataggtgtaatgtggtgcagcagatccctataacttattcatcttgcttggctgaaactttatacctgttgggtaatagctgctcatttctccctccctctagtctctggaaatcaccactccactggttgatgttatgaatttaactacttgaggtatctcatataagtggaatcataaagtatttgtttttttgtgacaatgagggtcacagagacattaaatggcccttgtgcctctaacatgccacagtttcatgagtttctttgtcattaacttttccctatttgctaccacagggcattcctaacctttcaattatccccaagggatacccctgtacctggcataaggatgtttggtctcaccattgagtggctctgtgatcttggacatgataaacttttctaaacttcaatcttcccatctataaaacagagctaatactaatgacaaaagctacaatattaatacctaattgttttcaggataaaatgcaatagtaaatgtgtggatattttcttgaatctgccaaagcactgtacaaatattacctagcattattataactattatcacttaagtggaatgcattcttttaaaagtgattaacttttgtcaacatagagttgattcgtgaaagtataaatggtcctcattgacccatacatgaaaatccttgttttctaagatcttctcttcaaagcttctcactcagctttgaacagatactttcaaatggacactcacggcattttatcaggaagatgagaaaatgttattttagcatagcggctactagcacagacctgggattcccacatcctggacttgtatcagtccatttttatgctgctgataaagacacaccagagactgggaagaaaaggaggtttaatttgacttacagttccacatggctggggacacctcataatcatgatggagggtgaaaggctcttcttacgtggtggcagcaagagaaaatgaggaagaagaaaaagcagaaaccccaataaacccaccagatctcatgagacttattcactgtcatgagaataccatgggaaagaccagcacctatgattcgattacctccccttgggtgctcccacaacatgtgggaattctgggagatacaattcaagttgagatttgggtgggaacaaagccaaaccatatcattccgcccctgacccctccaaatctcatgtccttacatttcaaatccaatcatgccttccacagtccctcaaagtcttaaatcatttcagcgttaactcaaagtccacagtccaaagtctcatctgaaacaaggtaagtcccttccacctatgagcctgtaaaatcaaaagcaaggtagttacttcctagacacaatggggtacagatatcgggtaaacacggctgttccaaatgggagagattggccaaaacaaagaagttacagggcctatgcaagtctgaaatccagcagggcagtcaaattttaaagctccaaaatgatctcttttgactccagatctcaaatccaggtcacgctgatgcaagaggtaggttcccaacgtcttgggcagctccacccctgtggctttgcagggtatatcctccctcccagctgctttaatgggctgccattgagtgtctgcagcttttccaggtgcactgcacaagctgttgatggatcttccattctggggtctgaaggatggtggccctcttctcacagctatactaggcagtacccaagtagggatgctctgtgggggctccaaccccacgtttctcttccacactcccatagcagaggttctccatgagggccctgcccctgcagcaaacttttgcctgggcttcaaggcgtttccacacgtcttctgaaatctaggcagaggttcccaaacctcaattcttgccttctgtgcacctgcaggctaaacaccatgtggaagctgccaagccttggggcttcaaccctctaaagccacaggctgagctgtacattggcccctttcagccacgctggagaggctgggacacaggcaccaagtccctaggctgcacacagcacaaggaccctgggcccagcccacaaaccactgtttcctcctgggcctctgggcctgtgataggaggggctgctgtgaaggtctctggcatgtcctggagatgttttccccatggtcttggggattaacactaggctctttgctacttatgtgaatttctgcagccagcttgaatttctcttcaaaaaaatgggtttttcttttccactgcatcatcaggctgcaaattttctgaactgttatgctgtttcccttttaaagtggaatgcttttaacagcacccaagtcgccacttgaatgctttgctgcttagaaatttcttctaccagataccctaaatcatctctctcaagtcaaagttccacaaatctctagggcaagggcaaaatgctgccagtctcttcactaaaacataacaagagtcacctttgcaccagttcccaacaagttcctcatcaccatctgagaccacctcggcctggaccttattgttcatatcactatcagcagttttgtcaaagccattcaacaaatctctaggaagttccaaactttcccacattttactgtcttcttctcagccctccaactgttccaatctctgcctgttacccagttccaaagtcgcttccacattttcagttatcttttcagcaactcctcactctactggtaccaatttactgtatttttagtcctttttcacatcgctgataaagacatacctgaggctgggaagaaaaggaggtttaatttgacttacagttccacatggctggggatgtctcttaatcatggtggagggcaaaaggcacttcttacatggcagtggcaagagaaaatgaggaagaagcaaaagtagaaacccaataaatccaccagatcttgtgagacttattcactatcatgagaatagcatgagaaagatcaacccccatgattcaattacctccccttgggtccttcccacaacacatgggaattctggaagatacaattcaagttgagatttgggtaggaacacagccaaaccatatcagggctctagtctgagctccatccattctagtagaagagttttccctcctgaacctcagttttctcacaggtaaaggttagttaacaacagccttctcaatggagtgctgtagagattagataagggacgagtgtgtgaagtgtttagtgctattcttgggacataaaaaagactcaggatatggtattattaataacaaagttttactgatgcacaaacagcagcagccaaaaagacggggccatgcacatgagcacacagaagcagaacaggatggctcaggtgtccattttcattgcccattcctccatgccacctgctctaatatataccctttcacatggtgttaaaggatgaaaaacgcatttgcttaaaatccatctgctttttataacttccagagaccaaaatctgcacaagcagcagttctttgtggctcctaattaattcctaaacaaagactgctctggcagcagcccagtttatcaaaccaattgacctcctggtgcagaaatgatgacacagatgttgttgctatgtcacaacctcatttttcactttgcatcacttggtcaggccagacatatcttcaccttctgaggagtagaagatagtcccctgggtgactctgagaccctaattgttatctcccatggttatgggcctttctccactcaggcgcctcccaacaaaagtctggagtggaggtctggtgtggtagctcacgcctgtaatcccagcactttgggaggccaaggcagatggatcatgaagtcaggagatcgagaccatcctggctaacatggcgaaaccccgtctctactaaaaatacaaaaaaatagccggacgtggtgacatgtgcctgtaatcccagctactcaggaggctgaggcaggagaatcgcctgactctgggaggtagaggttgcagtgagccaagatcgcaccactgcactccagcctgagcaacagagcgagactccgtctcaaaaaaaaatagtctgggttggaacaggccagaaaacatcacctgtctttggttaatctgagggcttcccaagctaaggaatctctaatctgtagggttcttgggaggctaccagtaataataatcacagtggccatgaacccagtgtctattatgtgccaggcactctcctgtgcattgtgcctgctttatctcatttcattccacacaatctttgaagatatgagttagcatcttaaattcaaagtcaagaaaacagaatattggagatatgaagaaaggcttcacaacactggaggtgccatggcacttcgtataggtgagttaccaagaacttctttcaagttatctcatcaaggcctcactccatcactgtaaggttctgacaggttagacaactatttccaggtcatacaagtagtaggccaagaaatggtcttcaaaaggggtgggcctttcctctgagttagttgttcttccaattggattaggaactcactcttataaccccagataaccttattacctccttaaaggccatatctcctaatacagtcacgttaggggttgagcttcttaatcaatatgctaatgaagacagcatgggctcaaggctgaatctaggttttgggtggttgtgtgaccttgagcaatctcaggcttttcatccagaaaatgagtatattcttacacatttcatctgtgaataatcattaaccaccaaagttcttgccattgtatatcaaagactgcctttcctctattctccaatatcatcttcctcatttccatcagaaacctcaccacatgcacctttagcatccattttttctatcaacagtgttttcaaagcaacctaggcttttccaacatgcacttcaaaactctttgcggcctctacccattacttaattccaaagccactttcacatttttaggaattttttttacagaaacaccttacttcacagtaccaaaatctgtattagtctgcccacactgccatcacagcatactaaaaactggatggcctcaacaacagaattttattttcttacagttctggaggctggaagtctaacatcgaggcaccagcaggattggtttctggtaaggcttctgctggcttagagatggacaccgtcttgccctgtcttcccatggccctttctctgctgtgggtgtgctttcactgatgtcttttatctctccctctttttttttttttttttttgagacggagtcttactctgttgcccaggctggagtgcagtggtgcaatcttggctcactgcaacctccgcctcccagattcaagggattctcctgcctcagcctcccaagtagctgtgattacaggcatgtgccaccatgcctggctaatttttgtatttttagtagagacagggtttcgccatgttgaccaggctgttctcactcgaactcttatcctcaagtaattcgcctgcgttggcctcccaaagttagtgtctcttctcataaagacacaagtcctgttggattaggagctcactcttataaccccaaataaccttaattacctccttaaaggctgtatctcctaatacagtcacattaggggttgagcttcaacatattaatttgcaggggaacacaattcagtccataatatctgccattctgactgaaaacacctgcttaatatattgtcaggagattttaatgaaattttaaatgggatcatgttctattaatgttagttggtcaagagcatttgagcttcaagaacagctacaatttattgagaaatttctatttatcaggcaccaagtctgtacttaacatggatgcttccatgcctcacaatgattttatttgagaaggtattattgttggcactactttacatttgaggaaaccaaggctcaggagaaggcaagtagctagcccaagatcacacggttatcaaaaggctgagagatcccgtccaacagactctcctctcccatactaggctgttgcaatcattctgatggcccagaccttccctgcaagtgggaatccttcacctgagaacatctgctaccacaagagagaggaactgaccctcatctccccccagacagcctctggtgactttacacaccatctaaacaaagcctctggcacagccaccaacatatttcactccctattaaggaaagctgagacagggcaggcctctggacacttcattaggggaacatcaggacacataaggactgtaataaaacaggaaccgaagagggtgtccatggggaaagcccggagctgcttgtgcttgtacccctgcagaattttagaggaggaagggagggctgagggcacagagagacaagggcgggggagagggggatgagataaggctgccatgggaaagcaagagctttgctgccaacagagcaaacacaggatgtggatcccagctcagtctctccctagctgtgtggtcttgggcaaggccatttcacttgatgtaccacaatgatccaatccataagatggagatatcaatgcttgccaggtgggattttgtgagaattaaataataattttaaaaattagcatgttaaggctgtgactttccccctaatggtttcgatgaactgtaggtggacatgagggcgatctggctgcaacatctgtcactccattgacctccagggttgattcagctgatctgtctggcaagggaggtgtcctcttcccccctcactgctctatgtgtgtccctcccaaagctgtatgctccgttgaagaggatggccatccccaatagaggaggactgttttttggtcaagggcatacagtagctgcacgcccctgctagaacctccaaacaagctttcagtgagctgtaagtttatgattctccacctttgtaaattccccaaaacctctaattggtgttcagatcaggcatacatagggtaaggttcaggaaactatcttttaaacaaacacacaagagaattctttttgttgttggtagtggtagtaaatttattcttgaaaccatttcaatgagatatattaacatgtaaaaagctgtgcatatttaatgtatataactcaatgaaatggaaccttggtgccctgttagtgggaatgtacattggtacagccattatggaaaacagtagataaattcctcaaaaaattaaaaatggaactaccatatgatccagaaatttcaccctaggtaattcttatgtaggaagaaaatcctgctccacacctagtgaaataccaacagtaaacaggagaaaataatatcaggcaatttttaaacctcctagtaatagtggtagtgcaaggactttagaatcatgacacttggttaccaatattatgttgcttatgtaggatgaaatatatattatctatggattttagtctcctcctaggtgatctgggtaaactaccctaaataactgtttcaagaaataagtaaaataatgcacataaacttccctgcatattccccaccatatggtaagtgctcggtattatttctctgatagattcattttcacctagctcttgcaaatgacttgtaataatccctcaactgtggaaaacatagacacaaaaaaattttctacctcaattccaacctcacattttgtttaataaagcaatttacagggggtaaaaataattagtggttttaaatgctttaatacaagcaggcgctgtaatcatgataaatcatctctgacatatgcccagctcctccaagtgacagatgacaaacaaaagcaggacaaggtcctccgtcacaggcggaatcattgaattaatggaagaattattgcttctgaaatccactccagtcctattgaggagaacgttccaatttatcaaagccaaatgaacattaattgcagcagtctggtaagttttccagccactatgaccttcattgaattttaatccaaaacagataagatttccttccacacaagaggaaacaacacaattagctcaaaatgacagctagattatgaagcaggcacacacaaacaacacacacacattcacactcacgcacactcccagtgaaaatattgattctacttgacttaaaattcagcacaaaggaggtgagcagagaaaaaggtaaataaataccatcaccacatctgcctaaccccttccccctcttcattcaggagagaaattttagaggcggaagccaagatggagaaggtggcaggcagtaatggagacagaatttctgttaactgctgtaattaatgttatgtctcatcagggagagattaggaaaaaacagagaaggaaggaagaaaaaacaagtgttattttgctattaaagacgcccttgagctgggaacattagcagccgaagtttgaattgggtaattgtttgactgtatcggtggatttgcagacaggattaccacagtgaagtgaaatgtagttgcgctgaacctacagcgtgagtggctccctcagcatggagcaaggggccttctgctgggtgcagtttatagcctgacacaggcacactgccctgagatttagatgggaaggccagctctgtcatcaacctgctgtaagacatcgtgagtcaccctttgagacctaaaagctttgtttttgtatttattttcactctattaaaggggttgaactggagtttttaaaacgcttttgttttttgagaattaaatcagaaatttctgttttcatcaattctaaatatctgtggccagaaagaactggctgccttcttccatggtccagggtcaggcttgcctcaatatctcatagtctcgtaattggatgattatggagatgagctcctaaaaagtccttatccatccttgccccctataagaaaggaaatattatacagcagatggagcagagagctcatttggaactagaaatatatgtttaattctgggctcggacactggctatgtgatcatactagagagttgtcttaaccttctagaccttggttttatcatttgtgaaaacggaacagtaaaaacagcaatatcaatagtatcattaatacaacatttgtatagagtttgcatatttaccaacttttaactgtagaaactattactctcaccattttacagttgagaagacagaggcacagagaagttaagtaacttaaccaatgtcactctacaagttacgtggtgaggccaggattccaatccaggcagttctgtcccaaagtcaacattcttgttttgggttttagcctttttattttgaaagaattatagactcacaggaagttgcaaatttaggagagagctcttgtgtactcttcactcagcttcccccaatgtcaacatttttcataactataataaaataatgaataccaggacattaaccatgattcaacactattaactaaaccacagaccttatacaagtttcacaaatgatgcctcttccagcttatggtagctcttggttttccttggcttgggctacataatgctcatttctctctccatcttcataccatcttcccctgtgccttctcttccatgtgtctctcataaggactaatttttttaatttttttcactaatgtccttgtttttccactaatgtttttattttggtccaggatcccacattgcatttagttgtcatatctccctagtttcctccaatttgtgacaattactgttttccttgttgttgtttttgttgtttatgatcttaacacttttgaccattgcttgtgaattattttgtagaatgcccatcattgggtttgtccatattttttcatgattagaatggttatacatttttggcaagaaacccacagaaatgacattgtccttatcagtgcattacttcagtggattcataacgtcaatgtgtctgatgagtgaggatgttaattttgatgacttggttaaggtggtgtggtcagttgaatagtgggtcccagaaagatatgcccacaccctaatccctggagtttgtgaatgttatcttatttggaaaaaagggtctttgcagatgtaattgagtaaaaaaatcttatgtataacaatctgagttatcaaggtgaaccctaaatccagtgacaagcatcctaatgagaggcgcatggaagaaaagacacaggagaatgtagtatggaggcggacgtagaaattagcgttcaatagcccaaaccaaggaaaaccaagagctaccataagctggaagaggcaagacaggattctcccttcgagccccagggagagtgtggccctgccaacaccatgatttcagacttctggcctccaaaactgtgacagaataaatttctgttgtcttaagcttcttaaattatggtaatttgtcacggcagccttaggaagcaaatacaagtggtatcggccagatttctccactgtaaagtcactattttccttctgtaattaataaatgtcttggggggagacactttgagactccacaaataccctatatcttctcaaaatttcaccattaattttagtatacatcagtggatcttgtcagtagtaattattacagtggtgattgcctaatggtgattttctgtttccctctttccttctacatttattaactggaattctactgtaagaaagagcaatcttttctgccccatttatttatttagtcaattatttatatcagtattttaaagtcaatattcttaataacctcccaacatagctcaaaggatgtttgtgaaggccaagaacgataacagagtaggaagaatatttttagaggccaaaggagaagaaagggaccttccctgggcaccttgctgatgcttcatgagccttttatcacttattcctcccctcagccccatgaatgtggatctctcgcctcatttacagctcaggagaaagtgaggttcagaaaggttcagtaatgtgccaaaggacacacagcagtaagggaaagaatcacagtttaagtcctcatctgtcttgtctccaaaaccacgtgattcccaccaaatcaagctatgctctgaagactgggaaggagggagaaaggtggattaattgaagggagaggcagaagttccaatatatccaaatcaaagctcactttccatttttactgtgggcttatttggggcatatgagaaagggagtaaacagcgtgaacctcactgcaaatgtgctcacagcattcattttgtgttgctgttaaaataccacacaaaagccccaggttcttgaaggggaggaaaatgtggaacaggaggctggggcagaggaagttgggaatggtcaccaaggggacacacgccctgactctcttgccaacctgtccgcccctccccactttacttccctgcagtctctggatctcccctctccttcccttctcccagactccctgttgcaatccagtccaccctgccctgccatggcctcttctcagatccacagtgctgggtgcccctgcctccagccctctcatctctgctggatgctgtctgggcttgattgcctcctcagcctcggatcaccccgattgcccgcccttcactccatctacctcgctacccgactcccagccctttcttgaggttgagttccatctgcttctcttactcgctgtctctctcttttcctgttctcttctctctgtatcacttcctccatgctttttattctctgtttcattttcccccatctctgcttttgttgctaaatccctttctgtctgttcttgccaattctcctttatttttctatgtctctcccatccttggtgccccattctctcagtttcttctttatttctctccgtctctagtaatttcaacgtacctagtatagaatagtttctcaatcaacatgggttggatgtttctgtcggtattttcttctgcttccctctgtccatattatatatacatagctatagctatacacgttcttattctgcattgtgctttggccaggaggttcagtggaactgccttcaggcccttttcctgagctgcctcttgccatctccaagatacccttgtcaaacttttccatctgggctttatcattggcccacactaatgggacagggatgaagaacatccattctccagcttcattttccccatctacaacatgaaggtggggtacattctattgctgtggcaattgcttgcatgtgcaccccctgtaaaagaattgcacacccctgccattggctctgggcttggccatgtgatgtgctttggccgatagaatgtgagagaacccacatctgagcatcagtttcaagaggcatcctatatttttgccagctctcttgctcattccctctgccatgaaaaccaaatgtttcaaactggggctccccttcagccaaagtaccagaaggagaagacaagcagagctgagcctgcagtgactgcagctgccgatgtgtaaggtgcatgagaagtaaagcatggtgtggccaaggcactatgatttagagtggtctgtttgcagaataaacaagcaagagctgactagcctggaagagttggatattctatgaggtctcaggtgttttcagctccaagatcccactatatttcatacttctactgtttttttttttttttggaaactcttgctaaatggttttatgtgcattaagtttgatgttatgattttaattttatttccattttgcaaatgatcacacaagaaactcagagaggtgagatgactagcctgcatttctatagccggtatgtggaagtctaagcttgaaaccaggcctcctgaagccaaattccatgctcattctacttcgctatggtgcatctctaaatgttgtgaaaaataagcatttcctatatttcctacacatggaagctatggcttattttcctactttgcccacaggcctagctagagaccctgcaggcttttagtgaaaccatgttgttgaagcaagtcaagaccaagccacaaggttcatgtgacttaaaattttaaagtattttttaaagtctatacttacaatattaaaagttctactttctggaaaaaaaaacgtgaatgatactcatggggtatgtcccacttttgtaaaaaagtacttgggatatttgtgttacaaaacttcatcataccttggcaattgatataagcttggtatcttcatttttagatgggtgcagtgaggttaagaaggggatgtgacttgcataagatcatggagcatattggtggcacagcagagacacataactatttgtgctgcatgtattacatggtttttccactactagatgtttgccatcctcacattttaaataatccctctcaggatctgttttccctactactctgtcttttctctgaaaagcatttgggaatcacagtctgtaacagcttggcttctcctaccctagttgtcctgagtgaccttcaatgatattacttataaataacatggtggcagtattaggttgatgcaaaagtaactgtggtttttgccattgaaagtaatggtatttctcaaagtttcaccattaattttagtatacattggtggatcttgtcagtagtggtattattttcaatggcaaaaaccacagttacttttgcaccagcctaaatatttattgttttcagttgaattgggtcctccaaaagcaatatgttaagctcctaaccctcagtacttcagaatgtggtgttatttgaagacagggtatttataaaggcaatcaatttttaaatgaggttgttagggtgggacccagtcagagtgcagcggcatgatctcagctcactgcaacctccgtctcccagacccaagcgatcctcccacctcagcctcatgagtagctaggaccacaggctcacaccaccaaggccaactaattttttgtatttttgctatagacagggtttcaccatgttacccaggctggtctcaaactcctgagctcaggtgatacacccatctcggcctttcaaagcggtaggattacaggcttcagccaccgcacctggcctctggtgtcctcataaaagggggagaattggggcatagagacagacatcacatgggcagaatgccatgtgaagatggagttctgctgccataagccaaggcactaccagaacctagaaggaaagcctggagcagatctttccctggtgccttcagaaggtgcatggtctcacagatatcttgattttaaacttccggcctccaggattgtgagataataaatgtctgtcttttaagccactcagtttgtggtactttgttattgcaaactaggaagctaatgcacttataagtagcagagtaatgacatttatagaaccagggctgtgtgtcaggctccagcatatgtgctttatatctatcatctctgatgattctcacaacagcccctctttagacaggtaattccatcagagaaagtacatgctcaaatcccactactaccaagtcagttatggagccagaatgtgaacctcagaacacacagagtcacaggtcttacaagttagttatacttcctgtgcttattttctcaacagtagagcaggagtaataatatctattgagattactgtaagaatttaatgagttaaatacatgtcaagtacaatcacactaagcactgtaaaagtgcttgttagcattattaagattcttcaatgtcttgattactcagttattatttctactcagttactgtttctcttaagatatggccccaaaaataaacacaatatttcagttctcgcccagtacctctagaattatttgttcagaaacctagccttttattaattcaacttaaaatataagaccactttcagcaatgagaccccatagttggctcaatctgagctggtggctgattttgtaaaaagcttttttttttttttttctatctcttttttttctagcagataggcttttcattgctagatttaataggcaggtaaaccattccatgattgaatgattaaatcaatgaatgaaggaatatgctatgaatgaaaaaacgtcacggttggagcaatgatataaagccatcttttacagaaacctttaaaaagtgttatcccaatatcacaccgatcctctaaacaaagctactgaataagaatggtagtaataatttcttagatttgtgtgacattttatattcctcaaagtattattctatgttattatatcacagagtcatagatcatctaaattggaggcaactacaatagtcatctaatttaactattattcctctctaaaccccagtgactttgcctgcacaaactcagggagaagaaacccacaacttcttgattcggcctactccaccgatggatagctcagacactttgaagtgtttgtcctgtcgtgcatgagaattttgacctcttggaatcctgaatcctccctcattggaggccagcaatacaaatccgtggcattttctttgggatgatccttctgagagaaacatgccctcaaaattcttttcttctcctacatcaaaccaaacatttcttttcatcccctttctcaaaacattttgtcaccacaaagacaaaagggaaaaaacaaaagcgccaagataaaacatattggtctcaaacagtttctatctagtaactcttgtggaaatctttaaaacaagacacatcacattaaaatgaaattatatttctcactgttaaaaagggggagaggaggaaagagtagaattatatgaccaaccctctgaaccacaagtgataactatttttgttgaaagcaactttgatctatgcaaaagtgaaatatatattgaaatgccaatgtgacaatggcaatggcaacaaaaagcaaaatgaaaaaaacaaataaatgcaaaaaagaaacaagaagttgtgatcacatctgctaggacctattgcatttcctcatgcctgcgtgaagcagataaactcttcccactttcttttttttttttttttgagcagagtctcactctgttgcccaggctggagtccagtggcgtgatcctggctcactgcaagctccgcctcctgcctgcaagcaggcagatcacgaggtccggagatcaagacaatcctggcttcccactttctaaataaggataccaacactaaaagaacctctttctttatcctgcaagtttgcatatgtagatcacaaacttagctggcaaatagttaggggcccataatagcttgttctgataaacaatgtaaagtgcaccccaggattcaagccatggttttcctctgactttgcacctgtagtcaaatcactcagcctgctttggatttcttttctcctatctataaaatgctggcatgagcaactcctctccctaactgacaagtttccaatttctatcaaatgttttgtgcacctggagtgaatactctataaaataacagacatgataaccctcactatagctaacattttaataacggctactgctttttgagcacttacagaatgtcaggcactgtgccatgcagaactgtgcccaagcacacagactctcagtttggacagaccagagttagaatctcaacttcagcacttattggtgatgtggatgggcaagatgcaaaaatcccactaactcctaagccctcatctgtaaatgaagggcaacaacattacttatcatatagaggcattggaacaattagatgaaataatagaggtgctgcacttagtgcctggcatacagaaagttctcagtggtggcagtcattattttcattgtgcagggcatttgtgagtgtgatctcattccgtgcctagaaaaaaaatctctaagtattggggaatattattccagttttacaaatgatgaaggtaacttggccaaggacacaaaggtagtgatagagacattattcaaccatggagttgatttccaagtcataaaccctcataaaatacccatggattccacatagggtacagtcttcgtaagaattcactcatgaaatcttatcaatttaaatcaacaacggatgcatagagaaggaaaatggtggcctgttatatagattaagggcatagtttctgaaaccagcttatatagagtgaaaaattgggtttgccacttaacctttgtgtgatcaatgtcacgtagataggtatttattaacatttcagattcctcatgtgagggacagtatccatcttaaggtttgttgtgaggattgaaagtgataatatgcagagaacaaaatttggaacactgcctggcatacagtaaatactcaaaataaatgtcaggtattatgattatttctctagatcaggcagcaaaatagcagcaaatataagactaaagccaatgtctttttactcctaagttgaagtcctttaaacattgcttcaatgacaatattaatagccatttgtgactatgcactcagtatgtgccagcctgggtattaggcaccattgtatgttttttccactcttttctccactcttttcaataatttttctccactcttttcaataattctgtgagattggtatgatcagttttgtttcatacataaggaaactgaggctcagaggcatgaagggatgtgcctaacgtaaaattaccaggaagcaggaagtagaagagactatattcagagccaggtctgctgaattccatcgctctgctttttttctctgcatcctgccacctgcacagctgaggagggtatgctgaagctgaggcagaggacaagaggagatgactgtttactctcactttctggactaggttcagagtacttccttgctgcatcaccttttgtgatattaatattcagatgatgcaacctttgggacaaggtagatgctcgactctagccttcacaagcctacaaagcatgatggctccaccccaggaggcatggatggtagcaggttccagtggctgaatgggagctggtttccctgcatgggtgagcaggatatctgtgctgtcaaaaggggatggagtgcatagaccctagcctccagacttctttgagatttgactagaagatttgggtcttctcacaaaccaccttggatcttcaccaaagatgaaaacaatagtgtatccagcagggtcagggccatgatgtcatgaattgccagacacaagttttaatcctggggaaatcctggccccagaactgcctttttgttagcccaggagacttagacaaatcaattaaactcatgaatctcagatttctcagttgtgaaatggggagacagatcccagccatcttaaatgtaaacactctttttgttcttgctgcattgtctgtggccagaatgacaagggtagagtctgagccacagagaggcctgacctccaggccaagccctgctgactgactgagggatcttagacaagtcctagcctgtcccagacctcagtatccaactatggaataaaagggtataataaatcagcacatctcaagtttttcaactaaactgcccctattaacaaaagcaaatacccttaagtgccaagctcctctgatctgaggacttgttgtgtctacataactattagtataatccttgttctataaatgacaaaaacaagacaaagggctcatacccgagttcagtgtcagagagagacctcaagtctgtgctccaagtctgtgcttatggctgtcttcctacctctagagagagcagtgttattggcatgccccacctctcagaggaagaacaccctggggttcagtgtctccaagacatgactctgttccctgaggggagggcagggacaggagagatccagattatggagccctgaatgggggaaggaactttggaccacacggtggtagccttgggtcactttggctcatgggtggggagggtctgaagggtgccagcttccacgttacctactctgccagccaaatctggaactacagggaatttcagtgacatctgggtcttagtgagttattatttcgaagctgaactcactgagcaaaagggaaagttgaggaaaacctaccatcctggggagaaagtctgattcagtgaaactaacactggacctggaagcaaaaaagacacattggaggctcatttataattgagataatactatccaggttactgggttacaagaaggatacatgcaagtaaatgtgctgaaacacagaaaatgtttaatgaacattggtcaaaattgagtctcactctcaaatgttaaaggaagaagagcattcacacccctccgcctcttcctaacattagatggtgtcccacaccccatgaggaactcagcaagtgccctgagatggtgcttataaatttgcaccccaaacttagcatgcaggcacccacttgcttggtgtgaggctgcatcatttgctaaatatacatatggaaaaagtctatcacactcattccatgaataacacaaaggccttgatttgttcctccacgtgatgagcatgcgtaaggtccaaaattaacattgctgtctggctggggagtgtatgtgtttttccaaaaagagaaaacttctaagatcttactcagccctaatcagaatgtctaatgcacagtgttcgttgaagagaaacgagaaagagactaaaactaaaggtcgctccgttgtggagtctcaaaaaatactgctgattgttaaattgaaggaagcaatgagggttgagaggtagctctgctctgctgagtggctttatgccaatcacttcacccctctgggccatagcctcctcatatgtatgttggagataccatttcctaaccttgggtatctggcagagccgtactaaagaagaaaaggagaagtgaatgtaagaggggctttgaggaatataaagcatcagaaagatgtgaagtttcttcctgagcccattagactctgtgctttctacctactggatttattttctggttttgtttttctatctaccatgcaatgccaataaatatagctttttaaagaaagcatataatataagcccagatacttttagactaccactcaagtgattccagccctagtaaccttctgggtggaggcagcagactcagagttctgtatcatggggccaacagagctgaacagccacatcctctctctgcaaacatgtggaggtgattcgctggacctcatccattcttggcaagagcacaatgagataatttccatacatgtatccagtatagtgcttaacaaatggtagatactcaagaaattcttgaattgagagaaaacagggtgtacaggacatagttcaggcttagtagccagatatgcttggatttgaacactcaagagtagttccatcattcgctggctatgtgatcttaggtaagtttctttgcccctcagccacagtattcacaactataaagagaattatggaggggcttctgtggacccccacaatggctacgtccagcccagctacaagggccaccatgcagttgttgcaagggttaaaacacctgacacatcaagggtacttaggaaaaggcagcctgttctggttttattccaattttgtttgttcagtcattcttggaatggccagttgtattctgaatcaccaaacctcagccctcagcaaagcaggccaagcacatgacagatgttaaacagctattcccagagatgtcagccaaaaggccgaggagttggagaccctttattttcttctctgaagcacaattagtttgtcacagctgacagatgatggatgggtatgcatcagtccaagtgacatcacagaatccatctgattttctgtttctcattctaacctcttgagtttggttctttccttccatctgtggacaatcccccgccccctccatctctccacccattcctcccccacgcaatccccgaccccggtcacatccccccatcactcaccatcacagaaatgtggaggatgtgcatctgctcctcaacaatctccgagggctcctggagagtgggggcggtggcttgggccagctgcccggagctgctcatggagacgtggaagtacaaggtgccattctccagccactgctgtctccagtgcaccagcgagatgtccgctgctgtgccagacatctctgcaagacaagacccgaggcactgggtgagccgtacgcctggccttggtgctccagggaggaaaagagcccacataatcaggagctcagaaggcatccattttttgccaggatacctttcctcacatcaagtctatgagatagggatcatcactttcatttatagatgagtcaactgtgaccaagattcacctaaagtaacagagtagtggaagcagggtttgcacccacatctgtctgaggccgtttttagtacatcacatgtgatcaggtaattcattctactctgatagtggaatgaaactaaggataaaagtgctttcattcttttgtggctatggaactagaagaagatgaaggaaagaaatccatgaaaggagtgggagttgagagtgtggattctttagaagttgagctggaagtactcatggccaaacctcggagccagaaaggcccaagagagcaccaactcagctgaggtagctcagggtcatcttgcatgggaaaggagcttgccaagagggttgccctgagcgtgttcctcttgcttccacaagagcagctccattttttgtaaggtatatactgcactcccaagcaaggaaatgttggcataaagtttccttggcttaaaaatactggcaaagctactgccccatcccaacgttctcatatagccagtgaggagtgaggactttctagtaaattgtaaaattcaatctcccaacttgaagtttctaactcttatctctatgctggttttccttctgtaaatacttttaaagtgattatcatttgaatagtatttttgttcaatgtatcatacctttttattagtaaaaaagggtcatggcataagatgatgaaagtgtcattgcaaggggattgtacaattgttccaaagtccccttgactaaaggtgtatgtgcctgcaaatgtcctagaaagacaaggcctatcagtgaatcttatgcatgaatacaagagaagggtggtggatttcttggaggattattaggtctgcattcaagggagacaaacaggagacaaatagcctttataatgtccatcagtagacaagtagtcttagtggtgctagaggcttagaaccttgacccctccctcctgagacagctatgaccttgaggcagtattcctacagtctccaaagacctcgagtgcattcacacacacacacaaacacacacacacgaggagagctgataggcaagctgagttacagcaacttatccaatcagctctctccatgtcccactgcagcacccatcatatctgatgacacggaatgaaaaagaatcaacttgaaaagaagaggagatgatactaccaaatcacttactcatcacccaattccactgaactattcttatatcatcaatgcccaatagactctccctccttgaggttcacaatcaaaaatccttaggagaagagtgtttagcacttaataagggctaaaaaatgttagctacgaatttttaagttagatattgatttatcatcatcatcatcattattgataggaacaggatctaattcatccttcagctgctctgaaaaaaaagaaaaaaaacaacaaacaaaccatgagccatccttgacagcttgctttctctcccactcctcattcagttcatcagaaaatccttccaaagtcatccaacattcaaccctttgcagtccctctacatcagccacatgggacaaggcgtcatgctgtcttgcctggcttactgcaaggactccttaacttgactctcttcttccacccttgtccattctattctcagccaggagccagaggaatcctgccaagcaaaagtcatctcacatcactaagccctccatttacagtctttgcatggcctcctactcattccaagtaaaagacaaagtggtgagaacatagtaagttattaggccaagcaaacacatgcttgggcttcccttgcagctggaagagttgaacaggccttgagataatcacgaaggtttgtcagcacttagagcacaggccccaaaggccctgagaacccattgtcgttctggggaggggctgattgggtgatcaatttgagtggtaggtctcctctcagcaccttctcttcatcccaggctggggtgatctgctgccccactgaccccctcccagccttagcacccaaggccttggcagtagcttctctggcagacagccagctgggccaaggcaaggtgaagacattatggtaaatggtctggctcatttttctctcagtgcatcaaagcctaaaaccagaggtccagggaacccagggctgaaagctgcactagaaatagcagtgtctaattcagtagttccatgtgctgctggctaggcaggcactccacgtgctgagagtccctggaatggcaccagaagaaagctccaaggtaggctacatctggttgacacagcctggcacagttgaaggcggagcgagcagagggatgcttgtggaaatctgagctccttgctcctagcactctctccagcctgtgcctgaaatcccactattaaagaggcttcccctttccatgttcagatgagaaagcagaaggtctcagaaggttagtgacttaagttcactggtgaatttgtacctagctagaaccagtggatttccagtccatgcaatttctactatgccagttgcacttacatctcctttctcttgactaaattagcccatgaaccaaaactagattgagctctttgtttgctacagcgatgagtgcacaatcagcagacagtaaacgttaaatgataataacagtgtgtgaaacacagtaaatattgaatcacagagaataactccggacttactttattacaaagaaaagaaactgttgttgaagaggagagaggaggggtatgaaatgttaaagggaaaaatgctttagcagaagcagaaggcctcgatcattcattcactcattattcatttattcatgcatttgtttatttattcaacatacttatcaaacacctactcaatcccaggcagctcaatagctcagaacacggagttaaatgagacatagccttgccttcagggagctcataatcatttagcagtggaaattctacccagccaaatgtctccttgcccatgttactgtccatacacatacacactctccattgaccatggtccaggcaactgtgtgttatcgggactatcttctaccatcaccccttcttcacacactccatccctgcaggacttacaactgtttctcaaacaaggcagactcccacttgtctcaggccatgagtactttctgcccaacattcctagcgctctcctcccagaacctatgagctgtcttcttctcagtgtttgtctctcagtccaaatgatacctgcttggaaaagctgtgcctgtccactctagctgaagtggtcctcttcacacacatccaacctttattatatcccttttacaaaaactttctacagcagttatcatgattagaaattcaggctgggtgcagtggctcacacctgtaatctcagcattttgagaggccgaggcaggcggatcacttgaagccaggcatttgagaccagcccggccaacatggtgaaagcccatctctactaaaaatacaaaaattaaccaagcatggtggcatgtacctgtaatcccagctactcaggaggcagaggcccaagaatcgcttgaactcggaaagtggaggttgcagggagccaagattgcgccactgcactccagcctgggcaacagaatgagaccctgtctttaaaataaaataaaataaaataagaaagaaagaacgaaagaaagaaataaatttatgctttacatttccttgaacatgtgtttattgtctctctctccaggagagcagagaccttgtgtgtcttatttcctgccatctctcacgcactttggaaagtgcttggcacataatacatgctcagtaaataattactgaatcactgagttacatacatatatgtatatatatttcaaatactcatgccctttttcatctttaaaatgcttaatgcatatatatatatatttcagtgatttggtatatatatatttatgtatttacatatatttcagtgactcagtaacacacttacttgcacacatccataataaaatggtggagggactaaaaaatagaattcaaagagtgttacatttcatcagagaattaaaaaaaaaaaagaagaagaagaagtaaaggtcgattgaaaactccaaagtgggaaaagactctcccagcttgcaaccaagaactacttccagaaggtggtggtaggagcattgcagaggatggacagattcatgtccctcagagaggaggaggagaaggcatagagatcagctggtcatcgcaggggcatgaagctgcgtgtgtatgtcggagtggagcagaatgtcaggtgagaaatgtagttcagggcctggcgtggtggctcacacctgtaatacctgcactttgggaggcctaggtgggcggatcacgaggtcaagagttcgagaccagccaggccaatatggtgaaatcccgcctctactaaaaatacaaaaattagccaggcatggtggcatacacctgtagtcccagctactcggaaggctgaggcaggagaatcacttgaacccgggaggtggaggttgcagtgagctgagatggtgccactgcacttcagcctgggcaacagagtgagactgcatctcaaaaaaaaaaaaaaaaaaaaaaaaaagaaagaaagaaagaaagaaagaaatgtaattcacacacagagttaagggctttgaatgcttggtgatactgtgtacattttattcagaaccagtagagtacacttggtcagaaaaccagtcctgtgtcccttaaaaacaggttaatagaacagtaacatgaccaaaaccagttcttgagattctctgctgattgattttccaattgcattttcccttttctcttcccctactccttccatataaacatttcattgaagtctccaagtcatattacaatcaaagtttaagcaaaagggggactaaatgcattgggtcaggaaccaagatgattcccataaaggcagattatgctgacatgatgaatataaaatgaaacagcagatattaaagtgggagaattggtgcaccatgccttttggcagtaggctgactccagtgcctgcctccctcccaccctggatagcttggttttatattggaatcataaagaaacacagggattgccttttcacctttttctgctctcccccatgggctgcaactcgtgaaatattcaacaggctcaaatcccctcaactgccccacagaagctgagagagaggatcagccttcatcagtgattctgggtagactgccatcctgcctcggtggccactgatgcctttcagcctcccggaaaagaaataaaaaatcccaaaggcatgttgtgcttttaatcggcttgttcttcctaatctatggcactcattgtatttttatttaattcctgaaggtcattaagaaaataagcagctcttctcatcaccagccatcttggtaacatctcccaagtggctaactaaccggccttctgattctacagcaccagctgaccctccagcagattatttgctgaagcccagagaaagcttccaatgagtttgcaaatgatctttttctcactgtggggaaagcagacattacatgagatgaactcaccgcccgggcagaaagagttgggaaaggtagtggtgttgactttaaccaaccttgccactagctattccagcattcatgggtgattgtcacacatcaagtcttgctgagtgagcctgggaaataatcgcaaatactcatgccctttttcatctctaaaatgcttaattaatgcaaagctttatcatctctctcatgggctattgcaaatggttctgtgccagtcagggtctcatcagagaagaggagacatactcaggaaggtcaatgagaagtgtttaatgaagggagcatttacaaaggcttgggctaggttaaggcaaactaatgatgagcaacgaagtactcccacattgataacagcaaggaattgttaccaccctaggcctgaaggggcaagggatggtggggatgggggattatcaaaccctaaaaatgccatagctgtaggaaagggctaccatatagctaccagataagaactatagctttttctaaaataatccagccactgccaatgcacaacctaggatggaagctttcaagagggtaatttcccaacctcatcctccttctacccaccaattttttgcaggtgtctcacacaagttgaccttgactaaacgcccaagaatgcttaaatgaaacaaatcatataagtcagccttcctgggtgcacagcaggtgggaaaggggatctcaagaagtaaatgaataggctccttaacaggtatccctaccttcgggcttccttccttccagccaaccattaaatggctaccaggatgaaatttctaacttgtcaaactgaccatataattccattgctcaaaaccctccaatgttttctactatccctcataataaaacctaatttattgaaccagacacacaaggcccttcctggcctgttatgtgcatttctccccagtctgatctcttcctatgcctttccttgcacttaaatattaattctcaccagatatttatataacgtaccacatatactatgtgtttttcctaatttaatatgttgtgctcctccatgctttcataaggaggaatattgcatgctgcataagatcacagggtctggagaccaactgcttgaatttgcatcccaggtcccatgtgttcaacctgtgtgtttttgggcaagctcttcgcttcttcatgcctcagttcccccatctaccaaatgaggataataacagcacctgcctcacagggtcgtttttagaatcaaatgagataatacaaacaaattagctgttaggttggtcttgatacttagacagcactccacagttacatttgttatatattacttcatatacatagttatagtatcctcttttactactgtcttggtgtgtgtatatatatatgtgtatatatatatatatatatatgtgcatatgtatgtgtgtgtgtgtgtgtgtgtgtgtgtgtgtatatatatatatcttaaaatagtctatacagctgacttcccttattggatcctagtgcagggacatgtcagaattatttgtgtagcctggtgcctggtacagtggctgaactgaataggggctccataaatgttctgtatgtttaattgagccgtcccatatttgaagtcagatgagtgtttccagaggacagagagaagagacagcaacttggggtgtcaataatggctggattcccatacagcaactctacagaaatttacctaacatcctggagcatgcacatgaaaagaaagaaatgttaattttcaaggagcttatattttcatgaagtgagataggggaagttcatatagaaaatggactctgttatgattctgtttagacatgagtatgtgtataaacagctggaaaaaaaatacactggaccacgaagaatggcactcactaaatagtgggatcagaggtgattttaatcatattctcattcacttttctctacgttttttatactgactatattttacctctgtagcagatgcaaatactcactttaaagattcatttagtcaaccaacctcttctgagagctggcattgtgggactctgtcctcaggagcttagtccaaggggctgagaaaagacatgctataaatagctataaagcaaagtagaaagcttagaggaaaggagattacttctggctggatctaaaaactcttcatggaggagtctcaaagaattggcaagatttcaacaaatggctgtgtggcaagagggcacttcagatggagaattggcacaagggaaggaaggcaagaaggtcacaaatgtacaaagggatacagtggggggaaccggtataaaacgcagaagccaccattatagagagaggctgggggttaccaactcttgcccatggagcatcacctagcagaataatacaagtgccaggtcccacttggggctcctttatgcaatcagaccaagcccgagctcagaggttaataaagctctccatatatcatgaattaagatgacaaggtggatggactgatgggtgaatgggtgaatggatggaccacagtcattctgacttaattaaacagcctgggttagtgaagagaatactaaattttgagtcagaagcttatatttttgtgatccctctacagcacctgactggtatcctggagcacaaattacagagcctctatgattttctttacttgtaaaatgggggtcacagtctggcctacttacatcacatctaatgtagaactgagagaaaataaggccatacatagcaacatgcttggaaatctgcaaagttttacagttagtactgaaagcaaatgcaatcatccaacgacatacttcatccatcaatataccttccaataattatctactgactatctgaaatgtgccaggcacagtgctaggtcctaaggatagattggaggaaaagatcaatttgactactatcctcacagactttccagtttagtctggatattcctttgttccctctaagcagcagcaagcatttccccttgcttcagttttttcagtcatccacccatttaatcattaattcatagtagaaggcgatgcctgtctaggacattacagtcttcattatttagcatgctgcaggtgtgcaataaatatttgtcaaatcaatgtatcactaaatgtacattttctgagtttcttgtcttcaagaaagtcacaatctaggagagcagaaaaaggaaagtcagcaaagatgataagtgtgtggtaatgaccacaagataggaggtacagcttgttacaggaacacacgtgagaggtcagttaatgctcctcatttatcaggagattggacagggcaagcagggagagtctataatctggacatttcataattctaagagatcctgatgtcaggccaggttaaatgcccacaggataatgccaatggtatgctaggtttgggaggtcacccgtggggacagaaggtggagaagtggcaggggccacaacatggccaaagccctctggcagcagctggagaacagactcaagctcttctggaaagaatggtactcttcaaatagtgggattagagtctccagactccagaggtgccttagactcctcctccccaaccccagctgtcagcgctcatctctgcctctgcctccaatctgcccattaccacctcctttgggaactgcatcttttacatgaaactgttttcccaagccactcagtgaagataaataatacagttatacccagttaaataagggaggggaagagaagaattaagagctattggcaagggagaaaagcatatcgtttcagattagatttggaaatagatagagggttgctggaattgattctcattactcctagttattctctcccgtaccatttccctctctccttgctgtatttctttgcttggtctttgtcatttcgcttcatgatatgcccttggtttctatgtttgcatgctctctctgtctctctttttaaaaacacagcccaatgtcaatgagtttttctacttcttcttctcctcttccttgtcccacaacattgcaaactgatgcagagagtgggtgactaaagaatggagacaggaactaacctttgctaacacctacttacgtgccaggctaagggctttcattcattgtcgcatttagccctcataggaaacccacataggtaaagtagatagtagaacaccgagttttcagctgagatgtctgaggccctaaaaggggactacacttttccaaaccctgattcacagattccaaattcagtgttttcaccactgtcctacataggctgagaaaggagcttgcatatttgagtaaagagatcgaggaatcaagtgtatgccaggaggtgtgatatgataagtaccagggcagtaggcatccttccaggtcactcaggtgctctgcctatccatttcatcatagtaaagtcctttgtttcctctgtttttaagatgcaaatatctcctgggaaagaggtatatgaagcattctgtcttacggtgaatgagtttttaagatcactttgctccttcctatatttcactgggttgacctttaacaaattaagttcacctctctgagcctcactggcctcacatgaaagaatgggaatcataaaatcaatctcttatgatagctgtgagaataacaggagataatgcattggaaggagcctagagcagcatttagcctatggaactccctgtcagttgtctgtcttctcgtcactcttttctatctcaccactgtcaaggcaagaagcacctggttgttttgagaaaagtggtgggggtgggagggggggtgacagtaccaaatataaagaaaaaggaggcagcagtcacagagataaaacttcctactttacttgtaaacagtttccaagacccttccaccttgtccccagtgccccgtaaaccttttaaagttatccctacagcaacgatctggaatcatggaaaattacaacaggaagagagtgtaaagggatagagatcaatgatctatcccacccattttactaatatgttaaataaggaccagagaagagtagcaacttgccttaaatcacacagcatcatgatgcagtgttcttctgatctcattgtttagaagaacaacgagacaaggattcactgagaggagaggcagaacctccttaaatcccaaaagtaatttagcagtatgcgggacaaggagtggtaaaaatcccttataatgccagggccccttccaactctcctgaagatgctgccaagagggcatcttaagtctctgtttctaagtctgacttgtcaaccccaacccccacaccccaacccaggggactcagcatctgaatgccacatgcatggattcagacctgacatgtaaaatgcaatgagtcaggaaagcatggcaccatgcagtgtgatgtgtgaggaggaaaaatgaaacctgtaaaacccagtgaccaaacagagcctagaagaataaacatacttgacattaagtccaacagctatttgcagaaagatgggagaggcaaggcttaaaggaatacctttatatgatgaattaatccccagggtcagacgctggcctaaatccattgcttatgggaatcatatcatggtccactagccccaagcaacattcttacctcttagcctttgttcagaccatgtcacctgcctgaaatgccttaatcttttcttctgcatacatggatgttacccatcattcaaaacccagctgaagtgaccctctaagagcccagttcaaaatgccctctccctctcctgagccctcaactcccctggcaggcttctacttccttccctgacttcacgaacttcacccatccctaattctcatgacttttgctagatcataagagtcttctggaccaggaattgcttttatctcctctgtgtcctttttggtagctcagcaatttttgcaacagcaggagcctgacaaatattgactgatacaagattaaaatagaaacccaagtaaagaggacagcatggtgaaattcctgactccaatttcacagattggaatactgaggtagagtgtgcaggaaggggactcggagagattaagaacgagaagtgggaaggaccaagtaagagctcctcagactaagcacaccttgttttacctgtcccctaccctctccttcacccctgctttatagccccctatgccatctatccaaacggcaccaacctggaccaaatgacatttgatgcagccaaaccaggacaactgagctctcctgtgccttgtctatctctgctctgtcattcctccatgtgcccctgcctttatgctcatagatccatatccttgtttttcactgttctctgtttcactgttttttaccaacctaactcttaatcttcagaactcagatgtaagtagactacacaaacagtcaacagctctcctcctctttacatctaaaccagtgtcatgtgacattgcagatatccctgtcaagaggtgagtctgtttttcctccccttgaatcagagttggctgcaggactttctctagccaatgggaaaatgacgaaagtgacacactcagagatttgaaaagcgtttatgtactggggcttgccccctcttgatgctcctgggatccctgcaattgtcatgtgagattagcttgatggaggcagagagaaggatggcccatctgcctatgctgccccagacaaaacctgctgctaaccacagaatatgtgagagaagccaacctgggtcatcctgctgctagcaaacctgccggctgaccacagatgcaggagagagcccatagagatcagccaagaccatacgaagtgcccaactaagctcagcgtaaataaccagcccatataaataggagcaaatcaattgtcataagccactaagttttggggtgtttgttacacagcaatagctaactggaagatgccgcctcctttatgcagcatcccccctcaccccaccacaagatggggttgggctttcctgctctgtgcgtgtcacgctatatgtaatcattgcttcagttatttcatgcttcacctaccctctcctccccaagtctctgagcttcttaaaactaaaagccttgtctcttttgctgcccactacctccctaacacctagctcagagttggtgcttaatgggcatgtgtagcacagaacaaactgatgttgaaattttgccctaagagggatcctgccgtatttccctcagcccctcctccttctaatcaaagtctctgtggctctgatttgagagtgagtgagtattgattggcttcaacagtactgcttcaggagtgtagtctgcctctatattccttaaataagctccatgcctgttcggtgtgttcacagcagccttgattgtaattcagcctctactccattacccttatttatgacgtggtgctggagcacagagccccaggccgtcagtggaatgattacaggacccttttgacttgcaattccacaccattcagtccaatttaggccggccacagatggtgccctgtggcaaggaaggggtgattacaggatgccaggctgagggtggggaggagggaactaacgaccctcttgattttctctctgcatcagagaaagatgaaaaaatggctaaggttatttaatgtcccttcccaccagaacagtgtgtgcctgaattatgacagatcaagcccctctccgatggggtcagacacgagaagtcctgggaccactgtggggacaccttttaattcagtgcaagatgccagactcctctctgcaggtgacatgacagaatgttgttcccatattgccaggctagcagtaggaaaagtggaattccactcttgtctttgctctgtgacctttggtgaggcattcatttctttgagcctgtcttctcatctgtcaaatgtggggactgatccctcctctgactccttccctaggtcattggaggcagtaaaaggaaaaattcaccagaaagaactttaaatagaatgttccctgtgcaaaagtcatggttatgattaatgccaatcaacctggtggaagatgtctagaaaactgaaaccaagaggctcaacaggaaaggctgaaattccctgctatttttttaaatacatcagctccccaatatagcacagggccaggactcaagctctaaaaccagccacctggattcccacctctgccactctattagttgaataaccttccagaaatcacttaacttctcaaaatctcactttcatcatataaactggtgaaagtagcgtcataataatcactggagcatgaaagccaggaaggcaagcactggtttgtcttagtcatcatgtatcacagtacctagacagtgcctggtaaaatgtaaccacttaatctaaaaataataaaaaggctaacacttattaagtgcttactctgtgcgagtctctgttcttagctgtgtgcacatatctcatttcaaactcctgacattcccatgacttaaggataatgataaagccacaggtaacaatgctgagttactgtgccagcacaagaaccagcacatgtctgtgctcaataatgtctgcagcagtgaatgttgctactactatctcctctgcggtgctacacaaataaattgcttttactccagttaatatagacatcatttgagatcacttgctttgaagcaacagagcctgtctttgattgtaaattcctggaaaaaggaaaagatacatcctttgaatatcctcttcaggccactgtggttacaacctggaatatcctcagggtgtcggactagaaatcaagacatctcaattgtcacacctccctctggctcccaccccacttggttctttccatttccagaatcacagaaactctaaacttagagtagactttgtcaactcagcaaatgtttccagagagcgtttcctgcaccaagccctttgtggaagcttttgggcataattttcctgggtctccacttctcatttagagtcaagaaagctgaaactcagagagaacaggggagttatcccaggttacatagcaagtcagggatagggctggtgagaatccagcctcttgacctcaaggacacgctctctgtactctacctgccagattctgagtagcctccttgctctgccactgatgtgctgtttcacccggggaacgcacttccctttctgaacctcacttttctcacctgtaaaatgggaatagacatggcatcttcagaggctgttcagaggatttactaaagaatgctgttagtaaagatgctttgatctcacactgtcttaatggaaactgtgttatgctatcagaaaacagcgacaactacaccttccagtctacatgataaaccttatacacaagtctcagctctattatttatctgagaataggaactaggagaaggggggcccatctagctggtgtcccatccactcatcccatgcaccttttttgaatgtttttctttaatgaccactgactcagggctgtaactctttccctcataaccaccaccctaattcctatctactatgtgatgtgaaatatactagaaggaacatgttgccagagccaggaggaatgtccttgtgatgggcaggtgtgcctatcacagagggaatcaggctgtttactggcattgggaacattgggagtgaggaccaagttagataaatcatctctagggcgtatatacattcaatcaggctaaatggatcataggtacacaaaaagccatgtttatacaacctaaaaacccctgtgaaaatgttcaaccgggggaacacacccatttatatgtctgttctcttaaagtacaagtgtgctcacaaacacatgtacttccttgtgaatctatgcatctgaatctgacaggaaagcattcatatctcctcctatgcacaaacatatatgttcacatatggctgtttcctcatacgcatgcatgtctgcacagactgatgtgttcatgtatgaatacagacaataatgctacagagtagaaggttttgcatgtaaaacctcacacacacattctataaaactgctccctcctaacactgacatcatgagtatttctgtatgtgtgcacattgatgcattccatgacacacgtaaacttgcatcctcatgtagatatgcacatacgtatgtgaaaactttgacaacacagtgttcacagggatatgtaaggccctcccacatgcatgctcctgtaatgtgctcactaggttcgcccacatatgtacatcatgcatgctccattgtgaatgttcagaccagcatatgtgtgcactggttctttacacaggtaggcacatggccaccttcatgggcagacatatgcatatgtgctcaggcatgcacatgcctgccaaaacaggttttaacccaagggcatacccaagccctcatgtgtgtcctcaaatacatgggtacataaatgacatcaggaaatgtccttctgagcctctgaaatatctctggatctttcttcctagaggccacgttttgcactcaaacagaaagaccaaatcctctcctgcggtctcctgaaagcctgtttcctcttttctggtatgactgacagactgctgtagagcacagaagagcagaacagccttgttctcgaactgtccatccacttaatcctttctgattttgttatgggaaaaaaatttccactgatttgctattttatcccctcagcctggtgtccttgaaagagagagatactgacacatggcagaaaaaggtcctctgattcccagctccaggcggcccagtgaccttcctctgggactctggcttccacacaccatgcaggaaacctggccaggaagccaaagctgatgtcctggatgctggggcaaaatcaatcaatcaatcaatcaatcaatcaatcaatcaaacaaacaaaaaggagaaataatgcattaatactccttcactttccatacagccagacattatgcttatcaatgttgcacactgcaattcatgctcaacacaccctcgagggacctattagcaagcccattttacagagaaaaaaactgagattcccagaggtgaaggcactattctaaggcactaaatgcagttagtatggagcacatctgcttgcctcaaagcattttaaaaactcaggagaatctggaaggaagcaggatgtgttactactgcctggcctctggaatcctcctcatttcaagtgcactttcaggagtttcactccctggaagaggccaagtgcactgcagagtcatttttccaggctgatcaaggaacagggacctggataagaagagaaagtttggggaacaaaaggagaaatagagtaggacaggagaatggacaggattggcaagaggaggagaaaaaggagagggagaggacagctttaaaaggtggtctagttcatctacctttaaaaaaaaaaataacaaacactgagccccttctctgtgctggacttcataggagatgctggcagtgaggggacagaacaggatttttcatccatgaaactcctagactagtgcggctaatgcctgttgcatatggcatgtgaaaacttgagtgaactttccaaatcagtgaagaaagagagatgaaaaatgacctccccttccataagtcagcttttaccactatgggcattaattatccatcaagcctattatgcatgttttcctgcataatcctcacaactacctttcaagatggttattatatcacattatatattcatttatgtatgtgtgtatgtacatgtgtatatgtacacacgtttggctcagagaagtgcagacactacatgaaaatcacacagtatttcagcagcagaggtggcattcagactccctcagctgtacttctgggtccttggcctaagccattccttttactgccccttctgccactggctgcatctactacttatggtagctgacacaaaatcagttatttagcctaagacagcagagctagatagaccttaagagagaatctagacttagcaaaactgaggttaaaaaagatgaagtggcttggccaatgtctgaactaggactagaatctagccttctgacccctaagatcaatactgtttgcagaatgcgctttatggcaggccatgcgtttttaagaatgacaactcttcaccctgatattgctgacccagaaggcaggaagatagatgcaggaacagtgatgcctccaagttcttctccaagtgctagagataaagcaaaccttccatccctaaggttataggattagcaatcctaatttacagataagccaactgaggccaagagagggaaagggatttggctacaaaaaagtggggcagccctcctataccaaatctaggaccctttcccatagaattcactctgaacagccctggaagcagctgggtgtagaggattagaagacaagtgtgggaggcaagcagatgggtggttccagaggtacccccttaattgctctggaatcttgtgaggtcacatagggcctagcatttagaaaggtcccatgctgagtttaaggctctgctgtcaccatcttgaaattacaagcaaaggcccccacgttttcattttgcactgggccctgcaaattatgtagctggtcctgtctttgacacttttcctttctgagcctgtttcttcatctctggaatggggtaaataatggggtaacttgacagggtgtgcagccaatactgtcttcccttctctgagccaaacatatatgtatgtgtgtacacatatacacaaatacatacatgcaaacatgcatcaatatataacaggtttgagagggcggcatcactttttctcagtcaaacacctttccctcacttgtcctcagttaacttacctgtaaaataggtttgctaatcctatagccccaggggtggaaggcttactttctctctcgcactaagagaagatcttggaggcatctctgttcctgcatctatcttcctgccttccaggccagcaatatcagagtcagaatttgtcattcttgaggtctttcccacctcttccttggcgctcgtctttctagtacagtgtagtaaagcattctcctgaagacacctgaagtccctgctttcctagtcctcatgcagggcaggccagaaatgtcatggagttttaagtcttccacctatcttcaccccaaccaagagcagcccttagccaaggacagatgggaggtggaggataaatgccctagtgtgggataattcctgggcacggttttgttgttgttattgtttgtttgttttttgagatagcgtctcctgctctgttgtccaggctggagtgcagtggtatgatcacgactcactgcagcctggacctcctaggctcaaacaatcctcgcacctcagccacctaaggactacaagcacgcgccaccacacccagataatgttttattttttgtagtgatggagtctcactatgttgcctaggctggtcttgaattactgggctcaagcaatcttcccgccttggtttcccaaattgcttacaggcatgagccactgtactctgccatttggacatgttctatcctgtcttccagaggtctccaatgagattgaaccccagttgcccacagcagtccttgatcaattatatgcccttcattggctccccttcctgcctgtctctcttcccctactggggctccctgggaccacctccaaaagaaattacttgcattcatctcctcagcctagggtctgcttctggagaactcaatttaagacagggctgctccaagcttaattgagataatgcatataaagtgcttagtactgcatcaggcatagaggcaagccctcaataaatggtaggcttacagaaaaaaaaaaaaaaaaagctactttacgagaagacatgaggaagatgacagaacgtttataattgatttctaaatttatcctcctaatgaaatcatctccggcagaccctgttagtgaccggtctggaatgattttcagagccctgtttcccaccagaggcacataccagttattctggctcctaggacccagcccaaagtgaaagctcatgagattgccatccactctttttctggccttcacaccaagtgagaagggagcatagcccatccagaatctcagagcctcagcatcagagtctcatctatcgaaccctttgttttacagatgcagaaagtgaggagcagaataaacccaaagtcactcagtatgtaagatcaagctcagaagaagaaatcaggcagcctgccattcactctccaaaaaaaacctctttattgactgatatattcattctttttaattgtcccacacacacagagatacacactagaaagtaagccccacagatataaggggttttgcctcttttgttcactgctgtgccctgcctagaatagtacgtggcccacagtagatgctcatgaatgttcgtgaagtgaacaaataatttttccatgacacccatagtctatccctgttgaagctcttcctaatttgcctcaggaagaacaagtccaaaggaatcagagcccaccccccattatgaccagaatagcatggttagaggaagctccagagctccaccaccaatgtgaaccccagctccaaaagtaagtccccaaaaggccttagtcaagttaccattccctccccatcttgcaatagtttactgtatttatcaaaggaggtaccccatatgtaaaacactaaagcactagacacatatcagctattactaaggtagaaagaaatgcccttcttccccccagagacttctctcttgttgctaatatattcaggaaaatttttccaaagagtgggaaaatgcacctatgctggttaagaggatgactaacatgtaggctattttcatcaaagtaataaatagagaatcacaaaataaaaacgttacatcctctccagtccctttcagttttttgttaaccaccaggaggtggttaggtgctacaaggtctttaacaagccagagaaagcaggcttcaggctcaaatcccaggcggactgttagtctcaactggctagagtgtcaaggaattgctttgctttcaccggacttgtttttatagtagccttctaattttagtaagtgatattagttttccaatcatcattatgctattgaagtttccatttacaatacagatattactttagaaaaattaaaaatcagaagcaaaagacagaatgcagacatggtcaaaatgataaggatggccctgaaatgcctgaggtttgggattctctggtctagtcttggttcttaagtcatcaggacaaaaactcagggtccagggctccatatcagctctgccattcacttctgctccgtaactttgaacacaaccattcccctccctgggcctcagcccctaacctttgaaatgaaaggatcagatgtctaaggctccataaggcctttccattttggaaacattttgaatccttttaggaaaccaacaaaaccgtaaaaaaaacccatggaaaatgcatcaaggccatgtgggtgcccctgcctgtctcagtgatatctcactcccaaatgaaaatttgcaaaccccagagtcttgttgacacccatttgtttatttacacggcttcactttttatgtggctttccttctttctgcctaatgcttgacaaaggaaataatgccagaatttaggaacccacgttcagaatcctcactcattagagcacttaaggtgttcacacgtaacaccagggtggcaatctcaatctcctctgccctcactacctgcactagagtcccctgtgcagtgtttgatggaaagagccttgaggagggcacacaggtgcttctgacagattctcaggaaagtcaaaacctgggctttggttctgacctggctcttccgtttggattttatcatatttactaagctccagttccaaggcagccagagacagggaggagtcagacaaggtcttctgctgctcaatggggcctcagggtggtcaggtggacattcagctcatcacatgcactcaaggcagcctgagaagtgcagtcccagagacaggaacatgacagagaggtggcgcaaagaagaagatgcttaatgatgccttaagaagcaaccataggcagtttcctgggcagatgaggactatgtgcaatcatgaagaatggacaggtgtttaccaagtgaagtggggaaaagcttttcaggcacaagttgaggatatacaagacattgagtgccactgattgataaatgggggccaaagtcaccaaactccccaagccaggagcctccagaaccagccagttagacacttggaaaggactcacatggtaagacacagagttttcatgtgaatagatggtttaggacacagtcctgcatgtgcaaggaggagcagaatttcactgcctcaaggaaaattgaaaaagctatagaaagccttgaaaaccagactcaaccagacctttctttctcaaccttctaaattgtatctgaatttctcctttatccctttgtactttgacacttacctccatgcttcctaaactctccttcccacttctcccttcctaaaaattccctccttgttttgtgcaaaacaaaagcattatgtatcttttccctaactaacaggcagaagcttttaacagatttctaatgcactgctagatgattccttaaggcttaaatccccaaagacaccttgctgaaaaagatagagacatctgtagttactggtgctttgcatttgattgttttcataaaacactgctaacaatgcatccgtttcactcacaggtagacacacacagagttaacctccccacccccaccatgaatgtttgcatgaagtgacatatagatgggaagtcttattcatgctgaacaagcagcatcctgggaggaaaagggtctgcattagcaatgaagacacagggttcagacagtgagtgctcttggccaaacctggaggaacacttccgaaagcaagttcacttctcttgtgccaagatctaaatatagcccacccccccaatttaaaatatgagccaaggacctgtggccctgcggttgctgtcttagctgctggattttctcaatataccccctacccagatctaaaccaagtagggttatatattatcatattatattatattatatatcataaaacacatattatcatatattttatattgtattaatttattttataatatacaatatataattataattattatataaaatatgtataattatatatgatatgtttttataatttttatggtatatttattatattatataatcacatataattatatgtcatatagtaatgtaatataattatatgtagtattatatgtaacatacaactatatataaattatataatatactatatattttatataactatataattataattataatcatataagtatacgtaatattataaatatatatgtacaactatttatataaatatatttttattatattgtaaatctagcatgatatattaatatgtaatataatatacacataacataatattggtatgatgaaatatatgcaatatataataatatattacttaatatatataaatatataataactaattccttcaaggcatattcatgacagtaataccaaatgcttactccaacatacctggagatgttttctatcaaaatctcctgaatttagcacctctagccttgctaaaactataagtgattacacctccctaaatgacctaaagcacttccagatgtttcatgaactttaaaatattatacaaggtatttttctcctcttttctctatttcaaggaacaagcacagtggtgtttaagaaggtcttatgtaattctcagcaatgacacagccgtgcctattttccagtttcctttaagaatcacaattagaggcactgcctgcgcactcagctgagttgttagaacagtgaaggtgcactgctttgccagccctctcccagccgccaaccatgtgagtttaaagccagcctggatcatgatcaaggtaatccaactaggcttcttaccagacctgagaacttggacaaatcactggcactgtcccaggctgtttcctcatttatgaaatgggagtaagaacaccttctcagccagggctgctgtgatgtatgcatattctgacatacagcagttctcagtaaatgctcatctcctttttctttcttcaaaatgttgtgcaattggttttctttggacccatgagcagaacttttcattatgttgagtttcagttccttaaattcagcccatcatagaatgggtcagctctccctgattctcgttgagattcatgtttgcctgaaggtctttttaatttaaagtgggagcactccacaataagaagtgaaaaagaaatccaatattaagtatttggacattgaagaacttcagagagtaaaacctccaggcacataagtataggctcccctgactacacaaaattgtgggcagatggtagtcataataggcaacgtctattgactgctcgccatgtgccaagcactcttctaagttatctgaatgagctatctcatgtaaccttcacaatactaggaggtagatactcatattaagcccatcttgcagatgaaaaaactaaagtgctcgaagatttgacaacccatcacaaattgcatggcttagactcaaacactccactttctcgctctccagcccatgcaattaaccactcctctgcaatagcttccctgattatgggcttctggaatcaggcagcattgtgatgtgtgctggcttcaacacagatgacctgagtaccttctagtaagtcagctcctggtctgtgcctggggatatctcactaataaactgaggataattaaatctcacttgcaggacagtgttgagaattggaggtggggtgagcggtgggagagggagagaatgaatgacagatggatggagggagggagagataaagaattgtatgttgggttctcactaaatggtagtttcttcactctctccctcatgagagcctcccagggtggggagcgatggaaggggtcatgtgacggctcatcgacattggtgtcttgaccatggtactatatataagtgaccatgaaggagctagaagctctgccctagaggaatgtgggaagatgctcaatctgctggtatgcactctggctgaggacatcactccctcagaattgtgtttctgcctccattgaatgaccggaacactctaactccttaaaatcagcacaatgctgggcctccccatttcaggtttccatatgggcctcatagggagaagaataaaccacaaactgctatgggggcgtgagcagtttcctgacatccagacagcttatagatatctcgcagatgttgccttgggcctggggatcctttggtctgggcccaacgaaggtcagaagttgtccaagaaagatgcagtgaggctgaatggagaccagaaggaaacacactgggtgtatctgggcctcaggtatataaatggagagccctctggctctgtttaattctctctgcttctcttatctttttgcctctcccctttgtgactgctttcttatttcttctgctgttccttctgttttccctctactttccctcccctatctgctgccactctcctcactctctctctctctgtgtatgtctctctctcatacacacatgcacacacacataaacacacacagagaatcccattttcctcaggaggctgaaatggaacagatttggagccttttatgttgaatagctttgcacttcctgaaggtatttcagagcctcaggaagcctcccaatgcctctgcctccttccgtgtttctcatcagctcaccataagtcccagtggtcatctgtagacccctcaaatgacaggactaaaatggaacttaggggtggccctatctagatattattctgtgctgagtcagcagagcccgacaatgcctgggaaggaagtagcagctgcttggtgcagatttgttgaatgaatacactaatgaatgtaagttcttgactccattttgcaggtaggataactggttccaagatagctaagtctcctgcccatagttagttaatggcagaactagggttttaactcacatctccagatacccggctcattccccaatccctatgatatcaagagtgtcaagcccagggctctttttaaagatgctttaagtgcccctgggagtctgtagattctcctgggaggaaccacacttccatccatcaccagccattgacatcaaagaagagactggctcatgagaaccccaggaaaaactgatgagaggatgccccagagagcccagccctctacacagtgcactcacaggtcagtgcactggcaggtccctgactcccttagtgccagctcttatctgtccactccagagaggggctgtgacccaggacagagagctggcaggactgagatgcctaaggtggtcacacacctggtcagaggagctgggaactcagcaagggtatcagatccaagagatccaagggtatcagccctttcccctttggagctcatccttctttcttttgaactcctgttgaaaccacagtgggatgcaggcagaatgaaactgtaggacaagttgcatcatattcatgagtgaagcagcatagcacagagataaaggtgtgctttctggagccagcctgactaggttcaaatcccacctctgctactcatgaatttgggtgcctttagaaagttgcttgtgttctctatgcctcagtgtttctatctgtaatatggggacactgataatgtccatccttatcactaagttttgtgaggacagcacttaaaaacttgcctggcagaaaaatcaacatttaaaaaatgttaggtattatggtcattattatggtgcatctgaatccaacatgaccacagcgatcttagagtttgggctactacaaattctgtggggttcccatccaggcttggttaatcttaggcttttcttcttcctggcttggaggagagagacacctgtgagagttatcagatgttgaagagcctctggtaccagggaggccaggaatttcaacatcgaggttaatttagtcatgctgtacactctgaagaataagccacacctttcctgtttgcccagcttgacactctcacagtcagactcaaggtacaaatgagctgacctggccaccaaatatgaagccagaggggctttagaatgaacacatccaatgtcctctgtctgtgaaggaaaatcgagggctcaagcaggtacacgtctcagtcccatgcctgagcaatcagctgctgcttctcccacatggtactcccttgcaaaaggcctggagctgcccaggttctgagatcttattgttataaggcacttcatgaaaataaagtactcctaaaggaccaagaggtgctggttcagccgctcctctgagctggggaagcgggggcgagtttcaactagtcactgcgggaggcaaattaaggcccatttgttttctacagggcacctcttggaaaattgcttcttctgaggactcctgggaaaaattccttctcttccaaaggtgaacaattttctccaaaagaaccatttattccgataagattgaagtaatcattaaaggctgtgctcctctttgtatggatgagcttttttttattaaatatgtagtgaggccccataatgggttgttttatgcagatctatagtctcaccttccatgtgacaatctaatactcaatgaatgctcacctctattttagtccaattcttcctcccagcagcacagtgggacacttagcatagtagaaataatagtaataaaacctgggttctaccacttaataattgtatgaattcaggaaagtcattttacttgactcaactgtaaaatggggataacaaattcatcccagtctacttcacaaggcattaatattatttttctttttttgagacagcatctcactctattgcccaggctggagtgcattggtgcaatcttggttccctgcaacctccaccgcccagttcaggcaattctcatgcctcagcctccagagtagctaggattacagtcacatgccatcatgcccagcaatttttttttttttttttaatgtagagattggaggatttcgccatgttggccaggctggtctcaaactcctggcctcaagtgatccacctgccttggcctcccaacatgctgggattacaggcattagccaccctacctggccttcacagggcattattaaggctcaatgaggtatttgagtttcctccctgtcagcaagaccccattagacacaacaaaaaatgaggccaagagatctgcacatgaaggcggtaattcccaaaacccatcaagacatttagtgggagacataggctgcccagttcccaaccccttaatttctctactgcaccacaggtttaagtcaacaacatcagaattgattcactgaaagtggattcaagtagaatttcttttaaatgaactttatggttcttttgcctcctccaaaaaatgaggacagtgatgatacctacttcacagggtagcaaagtcaaattaaacaaggaagtgaactagttttgtcagtagtgaggagaggcattgatcttagagattattattatttcccctgtttgagcacagagaaaactgaggcttagcagcagtaaggatgactgggatgctcaccgaaatacagatctcaaggcccacaatgaaatgaaacacataactgaaataaaatacagaactgaactgaactgaaatgaaatacagaactcaggaatctggcagaagcccaggattctgcatttattcagcttctgtctgggttgactttatgcaatactcaagtttgaaaatcctcaaacaagactgtcttgcatggctcttttcacataaaacagctcaccacaggccagggcttttccatataggattatatttgctgcttagaatcatactgaggggtaaggattactatactgtcacaacctatgaggaaataggttcagagaggttaagtaactttccaaaagtcacagagttgaacttcatatcccaagttggtctaactttaaagtctgtattgactccataacatgactctgcccctccttagtgactagaaccaccactttgtgcctcctttcaaggcactctggggagcattcacggactctgagcagcactgtcacatgtgctaattgcctctctcatagccctttgatttccttacctacagtcaggtgatccttcctcaaccccaaactccccgtaactgccacccccacctgatcatgctgcatagccaatcagaagaacagcactgatttccactttgcatcccagcctgggacaaatgtgatggcacagatcaaaggaagtcttggaattaaaatgtgaaacctgcagaggcatcttggggtgatggacagcctgatgttctggtgtgctgcttgcttgtgcacattctagatgtgtaaaaatgcccatctcctccacaactctgtcaagcaaggacacacaatgtgccccatcagttttttttcacacagtgttgtccactacagaccaaaaccaaacttctagcccaggtggtgagagaaacacgcctgcctaaattcataggaaggcaaccatgaggtccaacactttgaacagtggctgtcatacagcgggtgcttagtgaatatctgtggatgcagtagaagaatcaggcaggtctgcaggaaattatgcagtggcatgcctagatcagtaccaggttgagagcagatactcaacaaaatatttttgtctccagaaaaccataaatctttctggctgcagggatcagtctcagatttcagggcctctctctggccttcccaaccttctctctaaacaaaccagttccaaaatgttatagactcctatccaaagctgtgtgccccactcccaccattctttgctaaacaactgaataatgtcatgaataaattcaggctaaggtatacatagctcctagtaaaaaattcagaggaatggaatcaagttataaacaccatgaaagttcactgtcatgcatctccaactccaagacaggaggggtcaccatggtgacaaaactagcggatatttgggcaaggagtggggatgttctgtgattcatcttaaaccaaataggtaaccaccttctctgccaggccaggttctgatgctctagaacagagcttctcaacattggaactattcacattttaagccagataattatttgaggtgggcgctatcttgtgcattgtagggatgttgagcagcctccctggcctctactcattagacaccagtagcattccctgctccaccagttgtgacaaccaaaactggctccaaatatggtcaaatgtcctttaggagaaaaatcacctcctgttgagaactactgctgtaaagagaaaatgatgaaaatttactaatccaattaatacaaagcaaattctttaaaaaagccatggtgtctttcaccactctagcctgtgtattctggtccctctgtttggaatcttctccctccctccctccccatcttatccccgggcaagcctttattgctccataattcagggatcacttctttgcaaagctttctagaatgtcctatgatgggataggagatagacccctcctctgtttgacagcaagttgtactcccccttatcacattatggttatccctctgcactcttgaacaaaactgcacattttgaggggaaggtctcttcttcattcattttcaaattctagttcttaacaccgtgccctagcactgaataaatacgtgtatgaacagaaggctaacacttaatgatcacctgccatgtgtcagtcctactgtgtatatcctatcttggtatgtctttatgttaatgttgcatcataggctactactattactccacgtttctagggagtaattcgttcccagagagcagagataactcatctaacatcacacaggcagcaaatggcacaactgggcatatggacttaagtctgcatggctgacattctgcctttctgaccttctgtcttcccatttgcatgcttgccatcttgcttcctacagtagccaaagacagagccctctgccttgggcttttaggtcttggggaggtgcaccttgctgcttcctccttaccaggccataaatcctgttgaatctgggcagtgaagtggcaggcaggttggtatgagctttgttgatgtgtatgcctgggcccccagcacaggcacaagttgggctggagacccagggcaatggaagatttctttccacagcagcacagaccaaagcagaggactatgggcattttcaacactctcctgtctctggtggtgttattattttccttcaacctttccagtaatggggaccttcggggctgaaataagaacaataatttttttttccttctactctcctagagtcaagtccagaatttaataaaggtaacaaaaatactacggtattccaattcctctctgcagatttttgttttaatttagttttagccctgatgttagattgacagtcctggggtctgaagtgtatccattcccatagtatgtctggtgcagagacagagtgactcatttttatgtgtgcacacacacacatatacatatacacacagagataccatgaaaagaacaatttctcctacaaaatcagaaaattgtctgcattaaactgatctgtgcacagtctgtctgccccacctctgaccccccaaagcctcattctcaaatataaactggcattccaggcaatcaatcaagacctaacccctcaaagactaccaccaccaccactaccatttgatcctaactgcatttacccaacgtctggaattaacctctttgctccggccttagatagagcctcttcagggaacatggatcttagcttccgaaaggtttatggctttgccagcctgaagacttcccaatatctctggcaatggctttactccagcccccacccttcagaacaccatcccactccctgttcttactctgaatcactgacattggattcattcaaagaggctggaggtgggggcatggaagaggctcaacaagcacaaagaaaccttcagtattataactcaacaatgttttcagtgtgaaatatgtccaggattcaccctccttctaatactaattatttcccacaaggtttcctgttgcaaacattctaatttcttttctttctttatatatatattttttattttagcccttgttgtagctaggcagttattatgacacacatactttgttgatgaggaatgaacactcagagtaaaactgagttaaatctacatctgtgtaactcacttcacttaatcgaccaacaaatatttactgagtgcccaaatatcggctggacaccatgctaaattcaggggacacaatgataaataagacatatgtagtcagtcatgtgccctcctaactaaggagaaagaagtgccaatcagcccatacagtacataatcccatgtgaaaaaaatgcttgatgggacgagcaacaggtggctatggaaggtgaaaaaggaagcccaacccagccacactcatgcaagctcacaggaggccaggacacctatgctgggagctataggatgagtagaattttccagggaaagagaaaggacaaaagtgttccagccaaggtgaacagatatgtgaacataaggaaacaatagatccaaatatggatggtattagtccattctcacactgctataaagatattacgtgagactgggtaatttgtagacaaaggaggtttaattggttcacagttctgcatggctgaagtgacctcaagaaacttacgatcatagcagaaggggaagcaggcaccttcttcacaaggcagcaggagagagaagagtgagtgaaagagggacttgccaaacacttacaaaaccatcatatcctgtgagaactcactatcatgagaacagcatgagggaatggcccccatgatacagtcacctcccactgggtccctcccttgacatgtggggattatggggattacaattcaagatgagatttgggtggggacacagacaaaccatatcatggatccttcaaaaaactagaaaaaaaattatgcaatcccagtacatagatttggggaggcagggagaggccatagcaagtggtgaggctagagagctgggcagaggctgaagcatgccagacctcccaggccatgctaaggatctggaatttctcctgatatccatgggtagccactgcagagatttaaacagtttaaggagggatgagataccttggatagctctctgtctactctaccctcaaaaggaagggatatatctatgggcagtgggagtgaaagggagtgctatggggagaaatttaatgcagaggcagaacttgtctaggcccctaaagctgggaattctgagaggcggtgatgggtctgggacctggcatgctgcatttcaggagcactgaacttgtttcaatgtccaggagaagtgggttgataacagagagtggaatcatccatgtaacatatttattaataaaacaagcagacaagagacgccatctgaagcatagacttttcaccctgagccctgagggagaggctgatgacaggctagactctggccagtccaacacagattctggcctccccttccagatgccacaagacaattctggattatccacatggggatgtctgggccagagtgtacaggctcacctctcagtttctgaccctatagccagatgcagacagttgccctcctcctgtctttttcattgccatgggctcttcaggcagcctctctgatgttcattaaaacagtcagtctggccagtctcaagtctgagctgggcagactgagattgatctcataacaaaggagctggacacctgggcttgaaacccccctctcctccctgaatttggaatctccttttcccctcttccctttccagcagactcctaaatgatgaagagtgtctcatcaattcccccataattacctgctgtgtgtcctcacggagactgataaggaagtaattaggatagacatgcagggattacaggaagggaaaaatgttctgttgtcaagataatgccactttccctcacgccctcccagacaaataactgggcagggtttgaggattgttagagatggagaggctggaaaaggagtgaggtgaacagaggtggaagaagaaagtggaaatatgcatttcagacctgaaggggtccttaataatcatctaatccaggagtcccaaactcaacgctgtcagtccccaggcaggtcatataagtgcttggagcagaagagatggaagaacagccatagtacatgcctgatgacaaatgacaactgacacttggccttagggagttaccctgagggaggggtggggcattctcatccctttcagaagaggccacacagcggagcttcacagcacacattgccatgcaggaaggaagcccagttttggcagctcttctaatttttcaagagaagctggaaatccagctgttgtgtgaaaattctcatttttttctcactttggaaacttctctgttttttttttaatttaacaaaatatgagccaaacaaaatgatatctgcatgccagatgtggactgtgggcagccagtttgagatctctaattttagtccagtgccttttttatagacatggaaatgaaataagtattcggagaaaaagagggttttgcccaaagtcacagagcatgttaatggcagagtcaagactcaaacaagctttagctccttactctcccatttttcacaatacttaaaactggaggctgagcacagatcataaggaaaaaaaacaggcatataaataataccagtgagtgcaagcagagatatcgaattgcccaaagaaaattctgcagtggaaaatgaaaacatcatttcccatggtagttgtgggagaagggagaagaatgtacaaaaggcttaatacacaagggactaaaccatttcttgctttgatagaagaatcaggagcacccacttctgtattagaggattgaaattggggatacgaacacagtcccgacccactaagcagctaggaaactgatatgtggaaaggcagacccataaatcagtatgggtgatgaagtgttccaagtgccaagagagagtatcttcaagaaattagggtgagccaagataaaagagtgctgaatctatatggaagtgatggtgataagtaagtcctcaaagacaaaatgacacttgatatggaatttgaaggataaacattttaccagttaatggagcagtggatataagttaaatcctcaaggacgtagagcaatggtccccaacctttttggcactaggtacctgtttcatgaaagacaatttttccacagaccaggggagttgtgggggactggttttgggataaaactgctccacctcatatcatcagacattagagtctcatgaagagcatgcaacctagaaccctcaagtatgcagttcacaatagggttcgtgctcctatgcatatctaatgccatggctgatctgacaggagatggagctcaggtggtaattgctcgctgcccactgctcacctcctgctgtgccatctggttcccaccaggccatggactggtactggtctgtggcccagggattggggactcccaacaccgacaattgagacatttgaggacaccctaattacttccttatcagtccccatgacaacctacagcagcacctggaggggatggactccaggcagtgagagcagataagcaacagtcccatggtagaaatgcatggaagtatataaagcaggacagtgggggttacagtagatagggtttatgttcaaggaggtagccattggaggcaggctgaagaggagagttgagaccacatctgagaaggtcaagtgtgccaagcaaggaagtgtgcatatgttaagtaaaaaatgggcagctgctgaaagtttgtgagcaggaaagggagatcatgacagtactggtgtgtctggggaagattcacctggcagtacataaagaagcttgaatagcagcttgaagaaaccgatgcagaagtccctagggaggttgtgaagagctcccttatcctccctccttcaacaaatatttgcaataagacactgcaacaagcatcatgttacaagcattatgctagaagcttgggatccagtgataaataaagcaatcattcaacagatttatttcacacatagtatgtcccaggtactctttgacggcagggttttggcctcaatcatttcagagccaacaacagagtttggcgtctagtaagtgctcaataactgtttgttctatctaattttcatgaaaaagcccaaagggaaagttaaaggaccgagcttgggaaatttcagtagagctcaaaggcatggataggagagaagagggctgtggaatgaaaagatttctgattcttagatcaggattctgagtttcattctcgagtccttgcaattgttctataaccctgaacaattccctttctcggactcggggtcagtttctgcatctgcaaactcagggaacttggagtagttcccgaaggtcatccatgaaattgaaagcatgatcagatgggataggttgcacgcatacacactaaacatgatcaaatgggataaattagcacagaggaagatagtatagaatgtgcagaatctctcagcctaggaggatagaataccaagaagagaaaaaaagacagaaagaaagaaaagtaagatttgagaaactttgggactgttcagagctgctgagctgagtatctgtaaacctcttgaatcatctctctgccatgacctgccccctgaaagacctcaggctgaatgatcccttctgtgtcctgccactttcattattataattactgagtccattggtattctctagatatgctatatgcggtggaaaagcactttcccaatgattgttaattaatccctcaccactcctatgcctgagagggactgcttagtggcctcatttttcatcccagggaaatgggcacagaaaggggttgaaggttgacagggtcactcagccaggctaaagctgaatcaggactagaacatggggcctttctctagccattcatcagctgccccatggatgacccagccagagtgccacagagtaaatgggtttagcaacaggtcgctgtgagaagtgatggcaaatcccctatagagtgggtgacggagagccatctcatggcgaggaaaagaagagtggagtggatgccctgtggaggttaaagggaaaggaagatgaattaaggtttggatgccatcgaaggagtctgaactttataaggaaagcctggacttctactgggattcagagaaggaaaatgtggcctcttgctgtagaagcaaagtgaccttctgtcaggttaacctgcagctggagggccaaggaagtgtgacattccccaacaggtcagggaagacttctaggaagcagctgttgcaccttcttccaggccaagcaggtaacctactgcacttccaagttctttttttttttttttttttttttttactttttgaaatttttattataagcatttgctaccctttaaaataattgaaacaagattttttttgaaaacacaggtatgaggtagataccattccttgttccttgtccactttcctcttttaatgtagagatcaagttttggccagtgatatgtgaacagaagggaaagctcattgtccctccagtgctgacacaagaaagcctgaataataatgtagacaggaaaggaaagagggagaggagagggagaggagagggaatggtccctcccttgaaggtagagactaagttcactttttcacatggattcaggggccctggcactggtgggtgaagatgaattaggattgggttttagaggaaggggagaggaaactctgctattcttagtcaaccaaatgacaaaggggggtggacatgcagtggaggtgagaggagaaaccagatgcaattccttctccaagatcacttggcaagaagttctagctctcaggactccatataaagtggccatactcagttgctgctggggtcataaattcagagcccagaaaagatagacgactgtgatgaaaatagctaccatttattgtttactatgttccaggaactgggcttgacactaaaataataatagacatgactgccattgctaagcacacattctcctaggagttgtgcttggcacttctcatgcactctcccttttaattctcaaactgccccatgaaatgggaactgttatcgttcttattttcccatgaagaaactaggactgagagaggttaagtagtttagccaaggtcaccagtaactggcaaagcatggactcaagcccaggtcttagtgactccacagcccttacacttaatccatctgaggacttgcttctctttacccatggttttctccttaataagggaagctgatggggctggagtgcctgaagaagagcctgcccaagtcaacctggatgctcccattataccctcccaccaggacactccagataatgccaaagagggaacaattctcaggcctaactcctgctcattttcacacacttcagcctgaggcttcaagaaacccaactgacacaactagacacagtgaaagagaaattagccagatgttggggatgagtggaaaaacagagcaaagctcttcacctgagtccctctccgaagcccctctctggattggttcctggagggactccctgagcattggtttgtgatctccatgcaaagagcagaagagaatagaggacggcagggctccagggctgaaaggagccaatagctcatgttcctccatcccgacttcaacacttcagcttgaccattggtgtgagaccctgcctccagctcaaataacttttcctcttcgcctcctccccacctaccccttcctctgtgtcattctacatgaacacatgtggagagagagaatgtagcagacacagctcatctttcctccccagctgcaaatgcaatgtaccccttttaacaataataggaaaccccaaattcactgggcaattcccacctttctttgtagctagttgtaaccatgaaactgagtcctgtctaaagggatataaatggaagttagtttaacttgcagaaaattcctgaaatgaaggggatgtgcccttctccggatcttctctcctttccatggctggaatgaggacacattgggtagagctaggataggcctgttggctcatgaagtgaacttgagaattcaggccatgcacaacatagcaacaggcagagggaccctgtgtcctcagcagtgtcctgcagcatgcaacacctaagacagaaacaaacacctacttgtgtaacccacttgggttttccgtcacttttggctgaatcacttctaacacagcaagggggtatttgatagtgaagactctaagtgtcccaatcacagaagtcatatgtcctatgtcttctgtaagttggaggcagagtctcacactgatggtcaagctgaagtgtggaagtcagaatgggggaacctgagctattagctcctttcaggcttagagcccgaggtttcctgccttcctctttcccttctgttctttgcatgaaggtcactaaccaatgcccagtgagtcacccagaaaccaacacagaggggctttggaaagggactcagttgtgtgtgcttccaaacagtagggtttgatagaaagaagggctttggagacagaatatcaattgagcctcggtgttctcatccattaaattgggctccgagggttaaatataacaagccataccctcctgaaggaagggctatgtctgtcttgttcattgacttatctatccaccaatgatacaaaacatgactgacatacagtgctggataaagaattgataaataaatgggtggtgtgcaccaagcacatggcctatggtgggtgctcttggaatattagcgattttcaacacaatcctgacataccttctctatcagaacttttgactctgatagcagcttgtgaagattaaaacaaaagcccatcgaagatttaaaaaccaaaaacgaagtctgtgagttaaatttctgaattccactgcaaaaacacttagggagggagggtctcatctcccttttaaaattggaatgcagaaagataattaccttcctctttctacagccttcttagttcctctctcctcaacaaccctccattcataccccatttaattttcacacatgttcttagatgctaattttctttcagacttcactgggcaggctcctcagcttctgtctgaaaaggacagaacccagaaaactagaaaatgtagggcccactggggagggtgtcagctccccaccaccaaggaaatgtagatttaatacaaaagggaaagaaaggaaatgaatgaattctttttcttcaacttgttttcttttttttgaaaacctactttgcttcataataataataaataataatcagctatcagatatctgctctgtcaggctttagctaaatgtgttgccaccctttatagcataactttcacaacaagcctacaaagtagacaggattggctgggtgtggtggctcatgcctgtaatcccagcactttgggaggccaaggtgagtggatcacttgaggtcaggagttcaagaccagcctggccaacatggtgaaaccctctctccactaaaaatacaaaaattagctgggtatggtggcacacgtgtagtccgagctactcaggaggctgtgtgagaatcgcttgagccagagaggcagagtttgcagtgaaccaagattgcaccactatacttcagcctgggtgacagtgagactccatctcaaacaaacaaacaaacaaacaacaacaacaaaaaggacacaggattagcctatttaacagatgagaaaatgaaggcttgggggcttaagtcacttgcctaaagcaagagctaacacctgctcacatagatgcatacacaaatgtatataaccgtactattcacaatagtcacaaggtggaagctacctaatgtccatcatctaatgaacattcagctcaatatggcatatccatacaatgggatattagttggccttaaaaagctatgaaatacagatgcatgctaaaacatgaatgaaccttgaaaacactatgtttaatgaaagaaaccagtcacaaaatactctgtattatatgattccatttgtgtgatatgtccagaaagtagactagtggttgcttaggggagtgggtagtgctggggagatagggagttgatagttagattatggggtttcttttcacggtgataaaaatgttctaaaattgacaggtgatggttgcatgtatctgtgaatatactaaaatccatcaaattatatactctaaagaggcagattatattgtatgtgaatcatatctcaatcgagctatttctatttaaactgatgcctgaacccatgcctggaaggctcccaactcctgttaattccacctcatcacctgccattgacatgtgccacctcattgaatgttcagaatgattctgtgaggtgtgcatggccgctctcatctcacaaatgaggaaattgagggccagagaggaaaaataatgtgttctcttgcaaaggaaaatttaatttagaggaaaaaaaacctgattttttcaacatctctaatatgaggaaaccacccaggttcattataaagagaaaatgtgagagcagcaacagactctaaaatgatctagccatcttcaaactgcctccaaaacaccataaccaaaagatgcccatgtaggtgctccacagttattgcagggggggttggaacagtttttaaattatattttagatactgggcttccacataagacttcaataaaaatattactaagagagtttggaagccaccgatcttgtccaacttgcccattttattttactttattatgctttttagtagagacggggtttcaccatgttggccaggctggtttcgaactcctgacctcaagtgatctgcccgcttcagcttcccaaagtgctaggattacaggcgtgatccactgcacccgtccatttgcccattttaaacataagataattgaaagaggagagaaacaaggtctctctgagccacatggtgagttaatgtcagcactaggccagggcctgtgtttcactgcttccatgttgtgcactcctcttgtccagattaatggcctggtgcatgaagaataggctgcagaacctggtttcacttccaaaccatgctgcataccagaggtcaacaaacttttctttgtaaagagccagatggcaaacattttgggctttgcagatcatatggttttccacaattaacttggttattatagtaggaaggcagccagagacacataaaaaaggggtgtggctattttccaataaaatcagtagggggctacagttggcctgagagtcatcatttgctgtctccttctccaaacagatcctatactcttctttccagggataaaagggctggcatatgatgagcaaagtggtcactctttagtgcctttgtaggaactgtccatggtggtagtgccgggtggtggaatcaggaagttctgctttcaggtgcaggcttaccttcactgacccctgagactaggatacatcagccacaccttgagacatttatttttaatatgcggaaaacaacattcaccctcagggtcactgtaaggattacatgagaagtggtatatcagggctttttttttttttttgacggtggagagaataatgataagcaaagccaggcatactccttgccttcatctcccagcattctgcctctaccacctggttccagccaaactgccctccctgctaaatgccttttacacaccagccacagtggcttcatagtcctcactccctcttcttggaatgcgtttcctaagagcctcctgtggctcactcttctcatttttcaagttttagcccaattaccacttcctggaagttttcctgatgattatttaaaatagcaacttcagaccaggcatggaggctcacgcctgtaatcctagcactttgggaggccgaggcaggtggatcacctgaagtcagaagtttgagatcatcctggccaacatggtgaaacaccatctctactaaaaatacaaaaaattagccaggcgtggtggcctgtgcctgtaatcccagctacttaggaggctgaggcatgagaatagcttgaacccggtaggcagaggttgcagtgagcatagatcatgctactgcactccagcctgggcaacagagtgagactctgtctcaataaacataaaacaaaataaaataaagtaaaatggcaacttctaccttgcacccccaggggctcactccattgctttattttattcatagcccttaactgctatcttaaattccatcacttgtatatttatttacatgtttattgtcagtttttctttaagctctaaaaggacctttctgcttttctagaatccagaatgctgcctggaacatagtacacatgaataaatgtttgttgaaagaaaaatgaagaaatgatatctccaaattgctatgactttctgaattattttctccaccataagctcctatgtttggcaagtactaggctttaacacaatacaaacatctccatgttaggaagacagtctgatcatatattcctcaattcagtgtagttttacctggaacatagaaaatgtatgatgcaaattatctgagcctctaatgactctgattgtcaagagttggccttgcaactgaattgtaggagggtcatttcattaatttccatagtaagttagatctacagtttaacttcattcttacttatattttgttaatggggaaatcaaggtcccataaaggagaatggattttttcacagtcttgttcttcactgaatgaggaaccccttaaatcaatgaagccataaaatcctagtgccacaggccccttaaaaattaccccatctaataacatagataaagaactcagagcaagaagaaaaaaaaagggacttgctcaagatcacccagcacttcaatggtagatttaggaatgaaatccatatctatgtgtacccagagttggaatctcactactctcccttcatgctgctatttggagaaaaacagaaatggagaaaaggaaatgaaattattccaggcacacatttagcaatgctcataaatcctgacaatattaacaacacacgacagcttcgttgaacaaattggcagtgagtgtaggcagcttaaggagacaggaggtctggaaaggaaaaaaaaaaaaaaaaaaaggaccaccaggcatacacaaaaattttcccattctgctcttttctaagtctgtctgtaaaacaaggcctcagacaggaggtgctggggaatggtaagagtttgaaggaggtgcttgcatggagtgtgagtgtatgtatgagcacactggtgcacagctcccaagagactgtatggggaataatcctttgtaagatgtcactcatcctttatacaaattaacctccacctccctcatgctgggattaatttgctctttgtttccttgacattcagctagggagatctcagaagaattaaagaaagttcttcaagaggtgaaaaggggaagtcagggcttctggggcctggaaccctgaggaatcatcacccgatgcagcgcttccctacagggacaaagagggagatctcttgatccccatctcctatctgcaggaggaagcccacctcagcccccaaatcctggtaagtaagaataatatatcctgtttattctgtgcgtggtctatgcattccgttgagtactttgccagcgccatactaaatttcaccaactcactgccatgaaggttctggctagcctaggttttctgccacattcctgaccttgcctaaaatgtttgattctctagcctccagtcaaatgggttctggtttaaaggaccatccacatgattcctcagacttcccatatggccccacccctttgttctctaccccaaagtttcaggttcatgtcagtctatgtcctcaaaaggtccagcactctcccagaactcgaagctttagccattatgaaaagttctgacacaaagggagaatgtaaaaataaatataaaacaccacaagatacatgctcaaaggtatggctcctccgtttttcctcttagctgtgtatctgtttgctgtcagtttgcatgaataaataagtcacctaacattacttctggaaagaggagcaatataaataaatgcataattaagaataaataatgctaacatcaaattaatgaagaggggttttaaaaatacatgtatgcaaatcacaccttaggtgagaaatctaaaaaatcacacataccctatggtacctctgcatcagtgcaacaaattactatgaaatggggaattcccattttatacatgggtctacagaggccaatggagaaaaaatagtcatgggttaaatggcatattcaaagacaaaattattggattggtcacagggcaatgacctgtgatttctgggttgcagagatcaaaattcctgcacattaaggcctatcctaataaactctgagaagttagaatgcggagaaataaaaagagaggtcatttttaattctttattatctaccatatgtttcaaaagaccaggtatgtgattatgcctggcattggactgggtggttgcaagcattgttcttttcattcttataacagcaccgttaagtaataacactatgtcaggtaagcacagtgaagagtagagaaagaaagcaactttctggaggcaaaataactcttaagtgtattctgtgcatttgtataacttcaatatgtttgaatttttactgctgggattcccttttaatgatgagattaggtaatgaggtatcatggagagaaaagtggggagcttccctttaaataaccaactagtagacactgttttaagtgaaaacactatatggggcacaatgagtgagctcatagccaaggggagaagcagaagcaaacacaactgacctaatatccaaggcatgggggtgggaggccaaggtgctcatgacctcgggcaagccaatagcaggtacaataaattagctcaccttctctcacacagctaagtgaggtaacagatgtgatcatgttttgccatgtacaaagtgctaccaagaatctgtattccatggaattatcaaaatctaattttgtccttattcatataaaaaataaggaatcgatgattatctcgcatttatctatctacaacttcacagtgtttaatacttcctcatcatcctctcatcctcacggacatatggagagaacagaaggattaggaaagattgccattttcttccaatgcatctactagtcttctatgcagcatctgactatttgttaattattattttctactcaaattactattcaggacaactagtgtcctgatccaatctcgtgctcaatataacctcaatggatgtgtctcccccaaccttttaatcccccaaataaagcatgcccacttagcctctatttcttcctagacctgcatctaaaacctcctttcttgaagcatataagcaccttcaatcctacagatcctatccatttatcagttcatccatccattcagccctcctcccatcttcaaatctttccaaaaactttttcagatgccccatcttgtgctgggcacacataagaaaaggtcctttctctaaggagcttagcaattaattggaaaaacagaggatacttaaaacataccctaacacgtagaagaaaacgatcaatcatataagacaaaataggggaaggtgcttcttcccccctccaccctactggcactaatctaccaagctttagctttttaatggctttggtaggcactgaatacgggtggattattgggttggtgcaaaagtaatttttttttttgccattatctttttttttgccattatctttaatagcaaaaaaatgcaataacttttgcaccaacctaatatcttaactttcaggcctggtcatcaaaactcaacagcacacctgtccatgggaactctcttttctacctctccagacctcacagctgtgtgcgtaattttagtcccccagctttgattgctatctctcatcaaccacatgagttaatgcagttatctaggggacaggtagacactaggatgtagactgactgcgggtgatgatgggggagctgtagacctgggctgctgcttgagctgctgtttgatcccagctttccctcagggcaagcagaggtaatgggcacagcaggatttaggcatctgtggttcctgactacaacaccatcaaacccccaattttctctcacaactggtattagtatttcacatctagcccatgaggcaactgaggctcacagagggcaattgactttgttccaggttacacaactatcaagtggcagaatcagggtaggaacttcaatgtgtctaactccacgagcgctctttccactatgccacaccgcattggagctgagatttgaagggtacacatgatctgtgtgccgcagaggcagaaagaggcaaggtcaccctgtcccactttaaaaggtctgctgagatctcacacacatgcacatgcacacacacacagtccgctgctgccacacctccaatgtcatcaggccagctgtctttacaaaagccaaaaaaaaggaactcctttgccaacactccgtttacaaagaataaaaagagagaaacatcatgccttttcctgaagaaactttttctgttaagaagcaagaacccaacagcttccctgagacccatttttcatacgattaatgtcaggcctctcatgtttcctaatgaaacctgacactaactgagaaaaatggatacattaatattgagttcattagtaaatagattacccaaatgtttggggtgaggggaggaagaaggtgaaggaagaaggagaaaggggaagagaagcacacataccactcagctattctggcaagagactctctgaggaccacatgctaatcaaatatttatggattttaatgcaccgatctgttaagccaggaaatagtctcttttacaaaaaaaaaaaaaaaaaatttaaagaggcccacatgataccatagcgttttatttagatgggaactgaggcctgttgaggaaaaggcatggcccagagtgtggccttagttacctggacagggagaacaaatgacagctctcagagacatcagaccctccctgtcctcatcccacacacacctcttcatgtcaacagaaagtgtcatgaagcattcaagaccagcctagccaacctggtgaaacactgtttctactaaaaatacaaaaaaaattagccgagagtggttggtggcatgcacctataatcccagcgactcgggaggctgaggcaggagaatggcttgaactgggaaggcggaggttgtagtgagccaagattgcgccaccgcactccagcctgggtgactgagagagactcagtctcaaaaaaaaaaaaaaaaaaaaaaaaaaaaaagtgtcatggagaggaggaggggtatgactacttcggggaagagatgtagcctggcaggaacaccggttatagaagaaaaatgcccggtgcaccctgctaaatttttctgccacctctaaagaatacatcaagggctcaataataactactctctaccacgctaagacctgtggggggaatgaaggcaaaatggaaacagaagaagcttgttattggagccagtagagcagaagaatctggctcttccccttccttagtgtgagaccttggacagctctcataaaatcactgtcactgagctccagtgaggtcacaggcagaaatgctcttaatgtaaattgtcaagtgccataaaaggcaccatgttgctcttttgacaagatatccccttttctttatgtctatgtgatgaggcacaaagtaagggtgaggaggctaggaccccggtcccagttccaacagtgattcatggtgtgaccttgtgcaatgcccttcctccctctaggcttcagtgtgcccatcagcaacatggccaggcaggaccactactcaataaccatgtggggcctttgcatggtcttgtgcctatgacaaccctgagaaggctctaggaggaggccctgctcttaagcagtgccagcatggtgctggctcctctagggacccaaggttatccttgattacaaggtcaaagtgaagagatatacaggattgaattatctcttacaactattgtagttctcacattttgtgttttttaaagcccttgagcaaggaaatctcatgtcatgctctgaagagaaaacaacttaataaaagtgaggacagaaagaaagaaggaaatagtccaggtagaaatggaccccagagaaagtaaatgttcatgaatcaaatcgttttttttcctggttgctgcatttctctctgtcatgggtactttattcactgagataggaatgatctgccaaagcatttttacacacaagagatggagatacacagacagatggtgagagacatagacagacacagcctctaagctaggggcagaaactttcctgttctttgtgagcaggaggttaagaaaacaaaaagaaggagaaagggataataataattttttgaaaaatcataaagtagcaaacgatcaagcaaaagacaatgccagattcaaagaaggatctttgtattccaaacagcagtgacatttccttaaacagcaaagtggatccttttatctgggtctttttatgggccttttgccaccagatttatcagcagagagagaaaagcatgaaaaggaaagtgtaaagtgcataggaggatacaaagcaggaaacaaaaatgcatttttcccccaaatcttctaatgagactcactagctctattgtgacaaagtgagaggtctctgtggagttcatttcacatctcatccatcctcagagtaatgggaaaatcctgccttgtttctgcaaaataccagcacacactgtgtgccatatacactcaattccattagaggtaatggaagaagattgttccagaagttgttttcaattgcttgagtgcacccttcatttagggaaacaagaatatatgagctgtttgactcaaattgaagtatggacccaactttgcagctatagctatggttattctcttctggatgcctaggtgaggacctggtcaaatatcacctctccccatggttgaagagataatatttagcatctccatttcatgtcatgtattacaaagcagcacacagctattcattaactgttgttaacggaactcaggtccccgaacaaaggcatcctgggtctgtgaataggacaatcaggttcagagacaggagaacccacatgctaaaatgccagatggttgggagcttgaatcccccattctgccacttctagatgctttactgttggcatgccacttagcctcactgaaactcagttttatcagctgaaaaatgaaacaaaaataatacatgtttgttcgaataattcaatttatgtggcaaggctggtgaaaagtctgttagaaatcatatagaacttgggaaatgctaatgagcagcagtgaatcggagtttcccaaagtgagtcctgcctctgaaccatcctcttctttgtgtgattttgtgaatttagaaggtcaggttttcagagtagcccagggatcgtttggtactgccactaataaactaggaacatttggtcatttgtttcctctggctaggtcctggtttcctcacctacaaggtcctggcttcttcacctacaaaatgaggggagactgacttaacacgcaatattaccattttcaaactgtgttttcagaacagaattgtttcttccaacacggttttatatagaagaaatagaatatccataacaaataagaatgggttaacaaataacaatgcggaccaggaaccctgcatatttccatgtccctgatgaccttcagtggcatctcttctggggaagccaagggtactgtggcatactttgagtcttgacaacattgagtcgccatcaaatgacattctgggaggccacagaccagaagtcccatgggaatttcaggagcttggtgggttggatagctttttcctgattggcttccaaagttaggcaaggggaatagttcccccctcactgcatctcacactcacttcagaaaaactaaagtaggaagagtcagaagtctaacatcagtttaactggccaaaatcaaagtatgtgcagggctgcaatttctctagaggctctaggggagaaactattccttgccttttccagcttctgctagctttccttggcttgtggctgcatctgttcaatctctacctttctgaatgtgccatcacctcttctgtctgaagtcaaatctccctctgcttcccttttatcagaattttatagttacttttgttcaaactacattctgctctaaattcacttgtacatagcttactcatgctgaagaatcaatttgaaagctcatccaagaagctttctcggattcctacagtgcatgaacttgcttttccctggaatagagtcacagaaaacatttgaactgctgtgatgtcattgacaatagtaacaatagataacgtttgtgtggcactccccaagactcaggcattgtgataactaacactttccatgaataatgtcatagaattctcacaaacatcctgtgagatagacactattattttcaaccccatgtacatatgagaatactgagagttggagagactgagtaacatgccctagatgactcagctagcaaggaatgaaaagcacattctaactccacccacatatatagttccaggatcccatctctctacctcacattaattagttctataccagctttatgtttcctactagaatgtgcatgttttaaaggctgagctttctgcatttttatgcccctcctgcacctggcacaatccctgattccatgaataattaattgaaaaagaaataaaaatataaaagaaagaagaaagagatcaaggaaggcagcaaggacagaagaaagtagaaagtagagggagagaagaaggaaggaggggggatgaaggagctggaaatactctgaaaatgtcacccaaagcatctctgtcttagatgttactccaaaaattcctgaagcaggaaaagcatctcccaaggtggccccatcattagttccagtagagagacatggggaggtgggaaaggagatctctccagcacagcatgcctgaaaaacgatgccagaactacacagccttccacaaaagcacgtggagaaaaaaaaacccatccccaaaagcagcattaacaggagaatattaaaccctctaccatggcacagtgaataagacttcaaagccctctacgtatggaaatgaatcctgcaggcaggtttgggagctagagctaggatgccgggcaccagggctgatgaaagcaaaggcagtgtgaagatttgctcagccatgataagtccaggtccccaaagaccctgcccctcccctgcttcattcattcccaggaccctgggagttccagaaggaaaagtgttgtattaacgctcagtaccacaaaccacttggtaagctacctggcttctggaagacagcagtgcccagggttgcctgtgtttgtctttgtgtacacacacaacctatgcgcacacaccccatagagtgacacagaatcatggacaacatagcagctccttgtatgagaagaagcatgtttctcttatgcaattcatctccttactcctcaatgatttattttgttttcatttcttcatccttgagcctaaagctaagggaagaggaaagaatgaacacgggtttcaactctagacctaagagtaatgaaaagggtgaggcagagggaatacaggggagggaagcagcccaggcagaggcattgtgtgcaatactaatgtgaatgctgcccttccattgctcatttttcctaaaggccctgatgtatttttcatccaaacataaattagttttattcatttatttattcaggaatgttgatatcaacactgacacatgccgcctgtacaagagtggggaacgtttttctccctggggcatgaacaggttggggctaaatgaaaggacccaggaatctaaggaagccagggttagaggtgggagggtccatggagataaaagagcccaacttggagctgtgttttctgcagcacaaaggagcccaggagaggactgccaggagccaagcctgtagttaattgaatcctccagccagcaaggcttgctcttgctactcatgctttgttttattattttacattcactcctgtgaatgttcaaccagtatatattgagtacctagtatgtgtcagccacagtctaggtcctaggccttcagtagaaaataaagagttaaaaatccctgaccagatggatttacaacctaaaggagcatcagatgtaaacaagtatgaatcataaccacagctactttctgagagctctcaatgtaccttgcatgactctaagtgcttcagacatagtaaatcacttaatctttacaaaatccctaccgtaatcctgcaatgatagataaggaaactgtggctcaaagagatgacgatcttgcccaaggtcacacagctgataggtggcagagcttggttttcaaactcaggctgtctggcccttactgaattcaagcaaattgaaactaaacaaaaacaaatgcaggttacaactggtgttaagtgccatcaaggaaatgaacaggatgcaatgacgagaaataactgaggcaaagggcttctctggacaaggtagtcagggagggcttctcagaggaggtaacatgtaaactagagaatgctacagattgttaccagaaaatacatacacttccctagtccactttctttaaccttttaacttctttttctcttccaccccatctcttcaccaatatcctcaattctgcagttttcttattagacctacttactctcattaattagttctgtctatccactattaaggttttcttgtaactcccattctgcccattctggcctatattttaatcctcacattgccacttagtgaactaagaggcaaaaaaaaaaaaaaaaggaaaaggaaaaattataccaggcattttccagatgttttattgtctaaccctcagtggaggctcaggggtgttacagaatttttccaaagctacctggcccatgggattacaaagagtaaagatgagactcacttgtactgactctttgtccagagcaccctgttattccatcaaggttttagttacttttttaaaaggatttgcatatctcaaatcaaggtaaggcatagaacactaggaaacagtataaccaacgtagagtttactaacttctgtgctaagtttcttggacaaatgttgtgtaaatgcttggtcaggttcaggatccagtagaatgtacagaattcagatctgtattatcctacagaattcagatccatatactctactgaattctgaacttgaccatgcatttagatagcatttgtccaaccaactaaccaaactcctaacacactcacctgtgcttatttgctacaatcctattatcttagtgcagtaagagttgcccaattctttcattttacagacatgaaaattgataccaaatcaaggacagaatctgggtttcctgacacatcgtttagcagaaataagcaattaaatatggggaaaaataactgtaccatcatatgtgaagtggtaacatagatatcttagatgttctcctgccagtagtgagagtgaacctgttcagggccacctctattccctcaaggtgatacatatgatacatgggtattaaaatcatacagacatgggttcaaatcctatcactgctaacctcaatatattcatttctctgaacttaatttccactgtctgcaaaatgggggccctaatacctatggtttaaggttgttatgaagattaaactggaatacacataaagaaataagattaatgcttgacacagcatttgggctcaatacacacattcttttttgttaattatcattaaattagtcaagacttactagtctacctacaaggctaaagggcatcctgctgcttctgcggtgtgtgttatctgaggtgggatgacctggtatatctggcactggccgacatccaagtagggggctttggagtgaaaactgtggaaaatataatgggagtgaggtcaagaagaaaaggcacatgcagtgtttctccaaaatcatgaagaggttggcggttgagaagcactctctacaatgactaatggactttgtggagaggtgggcttttggagtgagacactttagaaattccttcatagatacattatactgatagcgcacacatagatggctgtcaacaatgagagagcgcttcctgatttagtctctcatttgctctcaccaccacctgggaggttgccccagctcttcactgtgcatacaatatgctagacactgcatgctagatacggctaagtctcctcacgttctcacaacaagcctgtatgtaggtcttatcattaacctcattttataatgaggaaaatcatggttcagagagattaagagtttgccctgaatcacacagctagctagtaaggccttctgctttgtctagtgcaattctctcttgtaaccacacccaattatctgttctttatgtagaaatataaatataaagcaaatgttttttctgaaaatcagaaataggtaataaattaaaaatgagaatgtggtggctacaaccacacaaagaaagcagcggattctcaagggctgggaaggtgtgaattgctaaagaggaacaaaaagacacatctgacctcacatctctccttgtgcaaagtccccagcactggatgacaagggcacatgtgctaaagggcagtgaaggcctagggacctaagtgttatatgtccagctttctgaagactaacatggcatattaatttagatttcaaaaccctgtgcatgctgcttagttggaaactaaaggaaatgaaaagaaattctaatcagggtctattaccagataagaagattacacttaacttacattctcattatttttaatatttgcaaccaacattacaccaagcttaaaatcagagagaagcataatccatttataagcatgaaggtaggtaactggggaggcctgttcagcctaggcctggcacttcaggtcaacccgtctcccaaggtggggaagattaagcaatttggtcaaaggcaaaatgaagtggatattcaaggcaattttccaggtagttcagtctaaaattgaccactctgactcaggatgccaaacaactgagaacataaacaaaatattggggattaactctatttctcttttaactctaccgatactcatttcaatttgccattcttagtctgcatagacataatccaagagatgttaggcagtgtcagatacaagcatgtctctgaaaatgtgtcccatgacaccctatatctacatggcatgaacaggaaagagggtgttctatcgttaaagaaatttaggaaatgttgagataagcaaagagaaatggatctatttactgtaaagttgctcggagcctatttacttgatatgctgatttgtgttctgtatccttaacatgtgtatatgtgtttgtttgggtgtgggtagtcatttgtctacagccttattcttgaccagagctctgcaaatctgggctaagattctttcagctcctttttactgtgagcaaaagggaggcaaagaaagacatctcaacttgtattttataagtgccaaacactttgtataaagccaagggcttcattgctataacattaggttggagtatttcattaataacagatctcctaattcattttttatgatcctgtcagcacatagaggaatttgtctctgtccaaaaaaaaaaaaaaaaaagtgtgtgtagcatctaattgtgtgactcccctccctctgccccattaacttggaaaagaagaattgctggaaaaggtggaggaaagtcaaaacaattgagttgtctttttatggatttattgagtggcaactggtgccatagagagagctaggcaagggcggtgaagcatgccgggaggcccattgatcatcacggacctgggtcaaaaaggattttatcttctgtcctcaaatccaaacggtatgctcatgcacacgcacagcagacaggaagctgccggggcgggtgaaggctcagtcctctccactctagtccctcccaaggagagatcaccaaggtcatagcagggtaaggaacatgatcgtctctgcctggccttagaagtcattgattccagtttgttcccttattaaatgagaaaaaaatgagggccagtgtgcatggcttgcctccctatctaagaaaagttaagtttgcttcgaacttgttgagaatctatcttggactaaattcagcagagatggagaaattagacatggccccctgccttcaggaatctactgttaatgggggtgggggaaagagacaagtgaacttattcatgctgtggagagaggaacacaaaggttcagaaaaaatactgaaaaagaatcgttcactagtccttaagagaccaggcagctctaaaaataagatggttattccttcctccaggaagtggagcttaattgccctctccttcagtgtagactggacttaatgactcacttctaatgaataaagtaagtaaagggaaaaataattgtcttgcagtggaaaaacccaatggacactgccccaaataaatgatgaagactaacatcagcaataagtcaggatgatatcagagactccctgatatgatatgatacaatatgataacaaagggacttcacctctggccagtgcttttcataactgttaagataatttttaaaggaaaacctgagagactgtcacataacagaggaaagcaagtagacataaggattaaatgcaacacagattgaacactgggacaaaaaaaaggacattggtggaaaccgagtaaaatctgaataaagtctatagtatagttaacagcaacatacaaatgttgatttcttagttttgacacatgtaccatgataatgtaagatggtaacattaggggaagctgggtaagtggtatatagaaagtctctgtataatctgtgccaattttctataaatctaaaacatttccaaaattaaaagtctaagaaaaaagatatagtactacagaagggttctgagagattaattactcctgcaagaaaggtttggagaatagagaaataaaaaacaaggctggcacagtggctcaggcctgtaatctcagcactttgggaggccgaggtgggtggatttcttgaggtcaggagtttgagaccagcctggccaatatggtaaaaccccgtctctattaaaaatacaaaaaattagccaagcgtggtcgtgggcacctgtaatcccagctacttgggaggctgaggcaggaaaattgcttgaagctgataggggggtggtggttgcagtgagctgagattgtgctactacgcttcagcctgggcaacagaacgagactccatcttaaaaaaaaaaaggaaagaaagaaaagaaaagaaaaaagaaaagaaaagaaaaatcagagacagtgtagtcagagggaaacataggtccagaatgagagaaaatgtgctcagagcactttgtgtatttgatatgatggcagagcacgctgggcagtggggaatgaggctgggaaatgaagacaatactgtaaagaatcttctacgttaggctaagaatgttagcaagttagcaaagcatttagagcagagaaagcttgtcatatatgaacaaaatgtctagaagttcggtgagctgggaaagacatgcagcaagttatgttcagtactcaagtcacaaagtggagataacagcacgttaaatcacaattaagccatcctaggggaccctgctttggcacgaccgccatgttgcatggtggataggtgaaaaggggattgctttatatgtttttacttgagagactgaaggtggaagcctgcttgctctccttgcaccctcaacgtctacactgctactctctttaacagaagcgcatgacagagcatttaggaaaagatatgggcaactgggagcaactgagaaatgaagtaacaaaaaacttaagatacatccatgatggcaaatctaagctataaagaattggtaggattaaggaaaagagaatacggcaatcccagctcaaaaaccttaatacctacccagtgtctccagagcaaaattcaaacgtctaagcatggcgctcaaggtctattataactttcgagaaactttttgtatttcacttcttcctttcttattgcattttaccacaagtattccaataccacatcttttaaaaactgaaacaaaacaaaaaaaatctgaattcccaaatctcatgcttatgctaagctgttttctcggcctaagctgcctttacttgagtcaaaatcctacactaccattcaatacttcatgcatatatcactgcccccaggaaaccttgcctgactacacaaacaataaaaactgtttctcccttcaagtctctacaattttcaaatttctctctatacaaaatgaaaaggcttctctgcatatataggtggccaatcataaccttttggttaatgagttatgaggtggaatctttggaggcacttctggaaaggttttgttgtaataaaggaaaaagttcacagggaaagctctgttttctgccccttttcttcatgtgtgctttagatgctatattagttcattaatttggatggggggtgctatagccatcttggagccccaaagagaaggccaagacaaccagagagattctagtcctgcacactgacatctggagctgcaaagtcacctatcaccaaagcttttagtcacgtgagtttattaaatgtcctcatcgtctaagcccctgggatacagataaaaatgtcctaagtaaacaccgcttactattaatatctttttaattgaatcaactgtgaagatttcccaacatttgagtccattttgaggaggaaaacctggacttctcaatatacctttatcagagagaaacagtcccttgaatctcacaggctgtgtcttcagccctgggctgaggagaacacaggtcagaccccagaaaacaattactctctcatgagaatttctaatctggcccaagaaacgctattcaaggccaagtcataatcttcttatgacttcatctacctttaaaatgtcaagtactgatttccgctgtactttccctgagagcaattattagtttaatgaggaacatgggccaccatctgcatcccaaaacttgtgacacttgagagatattatctccaccaacctggaacctcctacacattaaacacacagaggtcaaacaaaatattctcctcacattttacagtccaagaatcagagctgagctaatgagaccagaaagaatccacaattggccaacagttgttgagcttccaatgcacagggattgaggcaccaagggatagtagacagaagtggacaaagagtggtaggagaattaccaactactgaactgggaaagccatcccaagcactttatctttagtgtttcttctagtttatccaataattctagaatttaaggattaagatatccattttattgaaaagaaactcagagaaactaagcaaattgttcaaaatttcatcgctcggccaaaaggtaaagacaacccaagtgtccatcaacagatgaatggataaataaaatgtaatatacacatacaatggaataccatttagccataaaaaagaatgaagctttgacatatgcctcatcatggatgaagctttaagacactaggctaagtgatagaagccagatacaaaaagatggagtaagtgacttcacttacatgaaacatcttgaatggataaattcataaggaccgaaaatagatgagaagttatcagggttgggaggtgcatggaatggggagttattgcttaatgattgcagagagtttttatttggggtcatgaaaaagtgttggaaatacatggtgttgatggttgcaccacactatgaatgtaattaatgctgctaaattgtacacttaaaaatggttaaaatggcaaattgtatgttacatatattttaccacagtaaaaaaaaaatcacagcactaataaatgtttcaacagcaatttgagacctcactctggctccaaaatccagagtctttctagcaaaccataaaaagattctctaagatttagtgcggtgctgtccaatagaactttctgcaacaatggaaatgtgttacatctgtactgtccaatatggtcaacactagccacacagggctactgagcacttgaaatctggctactgtgtgctgggcaactaatattttaattttatttaattttaattattttaaatgtaaataatagccacatgttgggtagcacaggttaaactgaagagttgaagcataggttccaaaggaggccttatagcaaaatgatgacaccttggtgctaaaaagatcagtctttcaagttaagacttcagcattgaaaaatgtggccccaatgttccaacaattaccagcacaacctccaacctgttttccttgattttagttcacctttacctccaatccatccattacatggagtaacattgccctaatcgcgccatctgctttctgaaaaccccactaaatacgacccttaaatgcatattactaagtgaaagaagccaatctgaaaaggccacacactctatgcatccaactatgtgacattctggaaaaaagaaaaccatgaagacagcaaaaagaccagcgatagcagtgggttagcatgaagggaaggatgaataggcagagcacagaggatttttagggcagcggaaccattctgtatgaataacagtggtgaatacacatttttatacatttgaccacacaacaccaaaagtgaaccccaatataaactatggactttgggtgacaatgatgtgtctatgcaggtttgttaattgtaacaaaagtactactctggtgggaagatgtattgatactgggacaggctatgtgtggtggggaagggcggaaggtactcgggagtataaggaactctctgtacttcctgcttaatctttctataagcctaaaactacccccaaaaatgaaactgtttacaaagaaaacaccattaaaactcattattccatggcagatgaggcccctcatcatctggcctctgcctctcctcctgtctcttttctcattgccccctctccctgtgcatgccatatgccagctccctacactcatcaagctgtttctcactgcaggggctttgcatatgctagtcactctgaattgaatgctgctcacctttctaccagaactgcctctagagctttcaaaacccaaatccccctttttgaatactttcttgagccatgaaaactgagttaactactccctcttgtgtgcacccatgcactgagtaagtatcacagctcatatcattgttttgttactgatctgtcttttctaacagtctctgtgttgcttcaggtaggtcttactccttcccaccagaccttatatgatctggctccaggcaatctcttaagactccatccctcctccttccctccctccagcaacacaggccttgcctgatcctagaacacacagaactccccactgccatagtcttcccaacatctcttccccgtactagaacctactccacagtgagctcaaatgcatcctacagctcaaacctcaacttttaggaaagacttccctgaatccccagactaaaataaatgccctagttataagttatcaaaatactcaacgattcttccttcaaggcatttgccctaaacacatctatactatttataaaagtatttgttcaatatttgtcttctccactatattttaagctccttgtcctgttttttttaatccatgagtccttacccagtgtatatttctttaatatgaacaccttattaaaatgaacaaatttccctttactccaggggtcagggtgggtgcttaataattatttgtgaaatgactgtatttcatttatatccaagatctaagagagtccctgacagatagtgaatagtcagcaaattcagtatttgttgaacaaacaagtgaatggaaagttcagaaatcttggcacaaatgaaatattcaactcctttatggtaaaaatgattcaaacccatattcagagtttcagactgaagaggctgctgcaagtgaggacaaaaataatactatgtgtgtgataacaacatttattttcatttacctagtattttcaagcatgccctcctaccttactctttcagtaacgctgtgtgctggataatacaaacccacttctagaaaagggcaatggagtgcagagagaggacatggctcgccacatgtaatgtactgagctagtggacaaccagacaccaggctgcttagctcccaggcaaaggcagaaggtgggagtggaggctgaggggctgccaggacagaaaagcaaaacaagtcctcaagattcctgggtaccagagccggatggggagagacagaatggactctgattacaatctgaggaggattcatctgctgaaagagagttgattggattgtgctgtgatgccagagtctgtcggcaatcaaacaccctctggctacctctgagcatctggaattggaaagctggaggcagaggccggcttgcagctgggggccatgctgggggacatgggagcagctcagcttcaggctgcagtaaagtggtcaatggcatgcttgtccattccaagcacttgctaatgaaaaatgtttcccccagagaacccagagaaggggagcagcctacactggagatcaggggacagagggaaatggaaatattccttacaattgcagagtgtgccggtgcttacaaacatttaacttatgctatcactagatcctcccccaaaccctactgaattcattgccgtcatccccattttgtctatgcacaaatcccaagttagtagaaaggaaatgtctcactcaaagatacaaggtataagtagtagagccaagatgagaatgccaagtatgtctgattctctattaacaactttcttgtaattataatccaaagcaaaagtcttcatcataaagtcaaaatcttaaaatatgcagggggttagacttttccagggagataaatatgcatctcgattcttcttggacacctactgtgtgctggtagatatgccacatgggccatgacatatgtggtgagattattatcccatgtttgatacgatgaaattaagtgagaatctgagaaatgaaatcatttactgcaagtggcatggccatcaattaaaatcagaccaaattctttagatttcactttgagaactgaggagcaagagcagtgcaggaacatagcttctttaccctctctcaagaagtatgccagcactggctctacagtaaaacagtgatatcttttctgttcaatctgatcttcaattttaatgcgcttccatgtaaaatacgggtgcttaaaatataaaaaagaaaattagagtatgtcaaaaatggttaggaaaggggaatttagagaacaaatgaaggaaggtaaaaaaaatactggaaaacaatctctcttcataccatctcaggaaagataaagaattgagtatgggccaagtgcagtggctcacgcctgtaatctcagcatttgggaggctgaggtgggtgaatcacttgaggtcaggagctcaagaccagcctggccaacatggtgaaaccctgtctctactaaaaatacaaaaattagccgggtctggtgggcgcatgcctgtaatgccagctacttgggaggtggaggcaagagaatcacttgaacccgggaagcggaggttgcagtgagccgacatcatgccactgcactccagcctaggtgacacagcaatactccatctcaaaataaaacaaaaaaagaattgaatatgaagcatgtgctaccaaggctgacttacccatcaggtacagtgtccagggctcatagtcctttcaggagccaacagaaatgttttaatttttcttaaaactacatgcaaatttaaaaatgtatttttaagtcaaaagaatttttaatataaatatgaatataaacatctttgacacaattttacaatattttaaattaatcataataatttcgtaatgtttttattaaggaaggatccacaaaggtaaaggtgcctaggcttgcaaaagtcacacagtgaacctgcattatgactttgagattatcaccgtggccactgagtgtggagcacaaatgaactaatgaggattcacagagttgaggaagagtgttttcagctatgttctgatgaacatttgaatggagtttccatgggcacagcaggttcagagtgttaccaagagaattggaaatactcctggatgcaggtgagcatttctcccttagccaggccaagcagagaaggtggaattaaagtcacctttagtgttatcattttctctatctcaagagtttattatggatccttggaaccacaggagattggaattaatgtctagtcttgagttaagaatgttatatcatgcctaacttaaatcctgcctattttgactagagtctttaattttgcttttttaaagaatgaaaatttacaaacgttacttctcctgtaattgctgtgaggatttacttgcaataaggtcctcttggaagtctgggtacctaaccctttggagggatgaacagagtacctgaatggtgataagaaggcaaagattgtagaaacagctaaatcataaatttttgtgacgtgggcaagtcacttctcttttttggtcttagttttcactacctgaaaaagtcaagttatttgtatatgtaaagttgaagtttcttttaatactgaacacgtgggaaatcacagatggtcctatcccagaccccgatatggtaaagtcagtgatataatgaggatcgatcatacttagcgtttaagaagccttctagtttcctcaaaatccaggatatgcctattagtttccctacaggaagcatcattcctaagaatttgcagagggagagaaagtaaaggtcagacaggttaggtaatacatatgcatacatgtgcagacacacacacacacacacacacacacacacacacatacacatccacatccacacacatacccaaggccacaaagcaaatctggggtattgtcagtttcaatctctggcaacaggaaaaggtgagggtgtggctccatcccctgaatgagtgtaacattacaaataccttagtcctaaggttgcaaactctgattttgggcctgatagcacaatgagaaatcccatttccttcccaatcatttgaatgcgaaaggggccagcattaaactgggggcaattgtctttacatcaccctgggcaccatttctaatcacagacttgtcgaccaccagcctcttgtggcacctagatggagtgcggaaattatcatgtaatttacaacaggcagtgcctgaaagtgactttctcagcatctgctctctagtagtcccaagagcagagaaacgaagaaagttcatgggctgctggagaaatgcaatctcctccagttgcatccaactgttcaacagcctccctccaaacccctcaaacagatcccttacctctgcttctctcattctgtcgttcctctccccatccctgctgcttgaagttctattcatccttgagaacttcccttcatatatcccacctttctgcaaaggcctacccaaccaaactcacctctcactagcttcttcctgaaacgttgatctccaacatcggtgaatggtgggaggttaagcaaggtttaaatttgatctaaatataattcctctaagagtaaacctggatggactctcaggtccctcagagcccttttctctgtgcaaaacaatgcatagattcaacataaaacagtgtctaatgtgaaaaggatcaaacttgtattctggacaattccattccagtcctctttcctgttctgtaccttcctaaacccgtgctcttgagcaagctgcttcaaactgagaacctcagagtccccatctgtaaaatggaaagtgcttaaaccttaatggttgttttgaggattaacaggaacaacaataaaaaaagattgtagacatgacacaatgtaaatgcaaggaataattatggttatccctccaataggaacaactgatgtggcaagtaaagtaacaaataaacttgatattttccatttttggctcaagaaaggcaaaagctgtcttcacgatgtatctgttgcatgctgagataaggctttagtcattctactatgaattaaaagatattgttaagcatcttctatgtacgcatgtaggtcccagcagtagggaaagtaccatcaaaataagatgcaaagaattgtcctttgtgccttaactttgttgaaccatatggttcttgaaatctgtgggtgcctgtctggttatggggagtcttctgatcagtagccagcacagtgtagatgtcattctaatgtcgtctatacattgaggaaagaacacaggaattgaggtctttaactatcagagacagggggaaggagtggagtcagggattgcagattcaactgtgacatggccactcagctgtggtgtgagcctgcatcagtaactgtacttttctgagcctctgtttccctgaaagtagggaaagagagaaatgatgactagatcaagcaataataagtggatgaagaaaacatatagaggcaggagttaagaagtcagatggcggtgaacatcggcttttctcagaaggaataaacccaagaataagagaaagtagatgcaagcccgttggctttgactggttgctaaatataaagtagtagaagccaatgaagatcttattgactctgacccctagtgtgtgtgtgcagctgtccggcacatagagattcttggattacactctgaggttaggactgtcttggtttcattcttccatgtaactgtcaaacatttgctgaatatgtttggctctgtgctcggcaaacttactggaaaaataagaggaaaacaagaatgtcacaatccctgctatcaaagagcttatggtttagtgggtaatacaggcaattaaataggtaatgagggtgaagtgtaatgtggaaatcaagaaagagtccagggaatatgggagtatacaacagcaggtgtctaaccgagctggtagtcagagagggcctctcattttaaatgttatatggtgtgagaatttaaggacaaacagaagagatccaggcaaaaaagtggaaactataccaaagcaagaaaagagcaagtgcgctggggatatggagatgagcaggggataattcccaccctcgtggagctgctggtctaatggagagagtattgaacaaacagccatcctaataacatatcgtatgagctgtgcagataaccagaattgatgaggtttctttccaagttcatgactccatggtgagcatgctatgttctgagggtcactggaactgagcagccaacctgatttcaaggcctggctttactagtggcactctgtgtgactatggacaaggaccttcccctctctacccccagtctctccatctgtaaaatgaggtacttatattagataactgtgcatatacttttgtactctaaaaatctgtgctttagaatgacttagcatttttctggatcccttctttgcttctaatagaaacagtttttttcccccttccacattatgcccctttatgtagaattggtgacattatttatttctcatatcctcaggacttaaatccccgaattattctaaatcttgcccagacctgacaccacaaataaattctcaatctcagggggattgagacaaatgggggcttgccactcctgtgacctccatcagggatttggctccaacattctactcaaggaaaatgttgcaccaagtcaggctagaggggaaaggagaacattttttaaaaaacagccgagcatttgtgaaaagacaaaagaagtggctttcccctggatgcacatccaagacctccagcagattggagagcatttaattttgagtctttgcttcttgttctcaaaaggaaacaggattcacctaagtgggaggcggccagcatagcaagtcgctcccatgcatggggtcgtgtagggccgacttggaatcctagctccaactccaccctcattaaattctgtgtgacctggacaagtcatttcattgtctcatagactcagtttccccagctgtaaagtaaagataccatcaccacctcagggagttgctgtaagagtaaaacaaaactgcataggttgaatacctactacagggttgcaacacattgagtaatgaaaagcaggcaaactaaaccagaatgagggctctgcagaaagctggcaggaaatgtcaatggcgctcagctcactggtgccagatatctcccatggggcagttccctggaccctaaaaaggcaagggaaaatatatagtctaatagaaagcatatgagcattggaatctaactgttgagtgtaaattttatctataccaatctctaggacccttctcactcctctaaacctcagcttcctcatatataaaaaatagtacctatctaggttgttttgaggatttaaaaatatatatattgcatatcaagttcttaatatgatacccagcagataacatgtacacagtgaatgatggctaagatttaggatcaccctgcattttgtttgattcctatcacatgcttggttttgtttgtttgttttgttttgctttgagatggagtttcattcttgtcacccaaggctggagtgcagtagcgcaatctctgctcactgcaacctccacctcctgggttcaggtgattctcctgccttagcctcccaagtggctggtattacaggcatgcaccaacaggtccagctaattttgaagttttaatagagacggggttttgccatgttggccaggctggtctcaaactcctgatctcaggtgatataactaccttggcctcccaaagtgctgggattacgagcgtgagccactgtgcccagcctttttgtgtgtgtgctttgagacagttcccatgcttgttatcttccatttgctctgtcccatactaaaccattttctgcagtgctcgttgcccccggaaaaaatcaaaacctgtgtcatccaagttatcttgcctgcagctttcagttgggttctgctaaagagaggccctggtggtagatcagtgggcaggtaagggagagataggtcagggtatttattatcctccctccatccctgctgacctgtggcctcaacagtgggtgagggggtcctatggccagtctctataagggagttcctctttctcaaatcaatgttccctttcctggctccttcaggatggcaagagcttcctcttgtaatgagaagtctgattccttgttttgatgtttgactataaacagcttttaagtctcaccacctccctcttcaccaccaccaccactgtgccccatatctgggcaatctggtaggaatgactggacgctccctcctttggtgttggctgaggattctaaccatgaaagtcctgcctgagtgtggaaactctcactctggccccactctcgtgccacagtaaaaacccacaccagtctcttttcctggctctctagtcattctggaattgtgtgagaagcctgctctgctccctagaaatttcacttatataactaataagcctcttcctaccctcttggtgtgtgtgtaccatcattagtttcaatatccaaaccaaatttggggtggggatctctcctgcttttacaatgaccaaaatacccctgatgccagcctgcaatgcctcattgccccgggtccattcccttagccctgcccacacccttcattaaatgctctactgttacctcttctgagtatgttcagaagggagctatctgtttcctgccaggaccctgactgatgtaacaccgaaggtccatgtgtacgttcattcatgaagcatctgttaatcacctacttatacaagttatactgtgtctgaggggagtgtgtagtgaaggaaggctttacagaaagagaaataaaacaaatactttacacacattatctcatttcgttctctcaacagccctgcaaattggcatcattagtcccattctataagtaaaacaaagcgcagaagaaatatgaaaattgttcaaggtaacacagcatctttatggtggaagggaggtaagaatctaggactaactccattctaacctcccgcctccctttatggagacacaagcacccgtgattgcagtacagaggagaacatgtatgaaatgccagcagaacatgctgtgaaagatcagcagatagagaggacatttttggttacagttaagggcctcagagaaggtggcatatttaataggcttaaaagtatgggtaggatttgaagatacagagattaggaggagtcaaaaggggataaggctacataaaacaggtctgttatcagtgcccaggacatgatgtagagaggtgggacaggtaagttgaaccttggcattaaagacctcgtatcaccagccatctctccttatttcatgcagtcatgcctcagccaccggcagacatctatcttttctcttgacctactaggattgtgtagtgcataggaattctttatggaatctcagtttcctcatccgcaagcgtgggctgttttgttttgtatccacctgtctaaacgtggattaaatccattagtagcatgatagtttggaatggttcctaatagttaacattttctgagtcatattcacagtaactgacatcttgttttctctatccccctctactagcctttaagccatgtgattgaagatggcatgacccacatatattccctctacaacaccccacagagtaggcatccaataatttcagaagagtaaattcatgtagtccagcttccccctctgataacttagaaaattcaagaccagggagatagtgacttgttcaaggtcttagccaagccgattaatatctctacccaagcatcaacccaataaagaccaactcttagaactcatcatgaagggcttgtttttcaagcattgggctacattttgccaacctctgtttgccactgcagatgtaaggttaaagaaagaaatgggccaggtgagtctttctgtgagcaaagaaaaatatgagccttttgaacttgcctgaattatctgacaagtttaatcaagtatgaaataaaaagcaggcatgatttacttagttttccaaaatgcagttgatgaggtaccccacgaaagattattgaggaagataaatagctgaagagcggggtttaaaatgaagttgtggcataggaggcaagtgaggctcaggactcaaaggtctggcagctatagaaatgaagagatgctagtttataaccctgagaaaagcatcctatgcttatagaagcatctgggcttaaacttaagttacgaagtctatcaggaaccatggacgtccacactgcattctataatgagacacaataaataagaaaagaggcacattaagtaaataaaaaagaaaagagccaggcatggtggctcatgcctgtaatcccagcactttggaaggccaaggtgggtggatcacttgagctcaggagtttgagactagcctaggcaacatagtgagactccatctctacaacacacacacacacacacacacacacacacacacacacacacacacacaaaatcagccatgcattatggcatgcacccgtagttccagctactcaggaggctgggaaaggattgcttgaaccctggaggtagaggttgcagtaagccaacatcacttcactgcactccagcctgggcactggagcaaaaccctgtctcagacaaaaacaaacaaacaaaaacaaaaacaacaaaaaaaagaaaaaatgaagggaaggaaggaaggaaggaaggaaaaagaaagcaagaaagaaagagagagagaaacagagagaaaaaaagacagaaagaaagaaagaaatagaaagaaaaagaaagaaagaaaaagaaagaaagaaagaaagaaagagagaaaagaaaagaaaagagaaagaaagaaagaattagagtatgcttcaattacaacttccacatctcaggtttcactcatgctatatgttcattccaggttggcagggtgtctcagctcgtcattgtctcaaaatgacccaggctgatggggcagacaatatctgaaacattgccaaactccatgtgagagggaaaaaagaaagggctctggagagcccttccttgacaggtaaatgctctggtccatgagtggcattcaccacttccactcacagttatgtgagccatcccagtaaaaatagaccaggaagtgcaacccaagcgtgtacccataaaggagaggaatcagaaatatttgacaaagcaatgctaacagtttggccaacagatcctcccatgaaagtccacaatgttctgatgatgtggcgaggccccaggagcatctgagctttgccaagggtgaaggcagcttgtattggacagtggaaatgcactggcctaggggtttggaggtatcttaggcaggccacttctcttattgctgtttgtaggtgatgctctatgagctccttcccagctctttccaaggagcagattcaccattgcagaatgtgacaagttaacatagcattctgtttgttctgcgctcctgacacattacataactcatcctgatctgccattatccaaggcctctgttcgtttccccttgtaaactccttgagggcagaggccttgtctcactcatcttgcaaaacctagcaccgctgctacatactggaggcactcactgtgtgtttattgaataaatacacagataaagatttccaaaaccgatgactttcaggagtcaagccagtcagctcagtagatgtcccaattaatacactcaatgatcatgctgacaatggcaatgacaagctgacaatgttaatgataaatattaataatttaataagtaatattaaactatatagggcactttccaatgtacagatcccttttacctctattctctcctttgatgctctcatcaaccctgtgtgggaagcagagcagaaattggcatccctgttttatacagaagggaagtgaggtcccaaaaggttaatgggactttctccaagattacccagctcatcaatgtagatctgggacaaaaatttaaatcttttcattccctgaccatgatcttttcataagaaatcccccctctctctaactcctctgagaacacaggaatgagcccttattgtactatgagtacccaatttttcctgcatcttcctgattagactcctgagccatctcatgacctcagtattggtgtctgagctcctgcaccctccaaggctgcccactgtgccgccctgctccagcaactgtagctctctggaaacacctgctctgaaccacaaatagcgtctacttcatcttctcttttttttttctgagacgcagtctcactctgtctcccaggctggagcacggtggcatgatctcatctcactgcaacctccgcctcctgggttcaagtgattctcctgcctcagcctcctgagtagctgggactacaggtgcacaccactacactcagctaatttttgtatttttagtagagacagggtttcaccatgttggtcaggctgatcttgaactcctgaccttgtgatccacctacctcagcctctcaaagttctgggattacaagtgtgagccaccgtacctggccattccatcttctttttcagtgagcactctactaaggacattctcacagcagaatagaggctgtcttacatagacttgctatttccccattttgtgtgctgttttgtggcaacaatagtcaacagaagtgaactacaacaaaaacaaggcatactattgtgcaggattctctcagtgattccttgtaacagcaaggccacccacttcacaggtggcaagcttgaagtctatagcaattaagtgacagaaaagggagtacagtgatgagtggggagcatgagctatggagcaacagccagacctgtgctctcatgctggctctgccacttaccagctctgtgaccatttgctatttactaatacctgtatacttcaaatgcgttttctgtaaagaagggacattttcatgatcctctgggggtcatggtaaagagaagggtgtgtgtgtgtgtgaagcttttgcagaagtccctgctcatggtaaacattgaacatatgagttccttcttcattgtctgccttcccttcagacggtaagctcctaacaggtaaggtgctctgtctgtggtcacagctgcctccctagggtctaatacagttcctgagctaggatggatgctttctaaactcttgtaattattatgtgacttaatcaggtttgcagagatatttatctataaaatcactgaggcttttgcttctcagacatatagaacttggctacctctaacccagtgttatttttagcttcagttagaatcatagaaacctggaggaaggagggactttaggtcagcccctgttcatttgcacgagttacctctgcaatgccctatcttattatcatatgagttctgtacaatatttcactccatggtatggagtatgtgctcttttcacaaacaacttccacttgcagctccttagtttcttgcttgtaaatagaatgccaatcccaggtcccagcctgaccaccagaaaagtgagcttgaatagaagatgatgttctggaagctaacgatccgcaagtcagcagactttaagcagcaactaaggataagggattcaaaaaactagtgtaatgtttatgtagcaattcttcatcacccttgaaaaggcacagcaacaaaaatagcttccagggatctagaagtcttatcaaataggggggttttggaaatataccagtgggtgtgcatgcacatgcgcacacatgtgcatgcacacacacacattcacaatttaatcttatactcaatacaaacaaaagaagttatccattggaacaaaaacacaaaaagaatgttccagaaacattgccatggtattgaaattgaagaaaatgatcatacccattttccattacaaaatctgtatctaattttaaagtttaaagaacaaacgaatctgctgtgtttgagtaggataagcatagaattatactttccatctcccttcttaatttttgcaatgtgtgtaacaggtgagtttttccattatcattgagttaacacacaggggtgagagacagtatcctaatcttgtactgaaaggtgaaggtaaacaactttctttttttctatactattcgtcagaactcccttagtttccaggggaccagaataacaattgtcatgtgctgtttagaagaactgatctgaaaaactcatatataaaaataacatacatttttaacatgttggtttataaatataaaaatcccattatcacaaagccacagttggccaagtccccactgacaaaggattactgtgcctttaacacagtatgaagaacaatcatttataagcttaaggaacgccctgaaccttgattgcaggtgttggcacagaatagttctgcttgaacttaggtcaagtaaaacggggtaaattgatctaaatcatcatttacttaagggaaactaaagtgttgctaatgaagatagaaaatcttacaacaaacacaagataatacttgccaacaaaagcacaggccagcctggattaacaaattctctaagtgtttttccccatcatggctatttgttaaacctggaagagtgctattcaaatgcaaagctcttctacttgttgttaattatattattttctttttctaggcaccagtgatcctgattgctcttggaacctcttgggaaataagcctccatgtaacatgattataatgattcattatatttgggtaggttttgtagcttaaaagtgcttttccatctatttttaatattatcattattaataataatagctaccatttattgtgtgcttttcaggggccaggcaccattcagtgaacagcaaacacagtatctctactctttacgataaccctgcaaggaggttgcaatacccatttcatatggtagaaaactgaggctcctacaggtcaaatagcctgcccaagatcatatagaccctgcctgcctgaccccacaatccaggccatttttgctttaagtatgacatattatatgatcttaaagtcatctgtctactatctattatctgtcattcttttagactaaacactctttgaaggcagaaactatatcctgttcagagtcataatctcactaccaagcacagtccctgggacactgtaggcacttgatgaatacttgctaaaagaataaatgaacacatgagtaagtgagtgaagtcttataggttcttctactgaggcaggaagatcatttggtacttttcctgttaataaactgggatgcagaggctttaacaagagaattgatttccctaagggcacacactgttaagcattagaggaggaaccccatccacacccttctaacttctggtcttttggggattccacaggcccaggttgcctctttattacattaaaaaaaaattcatatttgtcatggcacgctagttaacaagcgatgagcgggaagctacaggttggccctaagtccaggtatattacccacctccctccacactgccacccttctattaaccccacttggaagcccatgaatgattatgaatataaatgtgaaggctcctcctttgaggtagatgagggcggggaaagagaagatggagaacagacaattcagacagccaaattcaatttgagggaatttggttcagtgctttccattaacaacactcaacgaaaaatataattcccaggacaaaagaagaaaagggaaaaaacaacaaaaaacaaaagcaacttttcatcatgcacagtcaatggaaaacaaatcaatcaccctgtttctccctggcccagcaatgcctcggtgaacaccaaaggcacacggcctctaagctgttgttgagtcctcagggtggtactgggagaaagaagtatctgaaaaagaaatagatggccaaaaatgtcatccatgttctagccttcttcaatcttccaaagaacatgttacagtttagaaagcactttacctaattcagtcatctgatactcacaaaacctttttaaagtaggtactattatagctcctattttattaaatataaacaagaaaatgagtcagagtaattaagtaatctgcttaagatcaggcagctaataagtgtccagaaattaaattcaggttcctttaacccccacatgtcaaactcttttttttccccctagagacagagtcttgctctgttggccaggctggagtgcagtgatgaaatcatagctctctcaatgcagcctcacactcctgagatcaagtcatcctcccacctctgcctcctaagtagctgggatacaggcatgagccacaactcctggcctaagcttaaattctacattatcaaatgcccccaacaatcccaagggagggcaaaaactaaacccagttggatgtccctacattattaaataaccacaacaatctgaagggaaggccaagactaaatccagttggatgtccctaccttatcaaatacccccaacagtcccaaagaagggccaaaattaaacccagctggatgtccctacttcatcatatacccaaaacaatcccaacagagggccaagactaaacctagctggatgtccctacattatcaaatacccataacaatcctaagggagggccaagagtaaacccagctggatgtccctacattatcaaatacccataacaatcccgagggaaggccaagactaaatccagttggacattccgcacacaactggggatttttcattccaagtcaaactcatcccaacataaaaactaaaagggtctatatatttttaatatggtaacatccctccctgccttgcctccctaatccaagcaaaacttgaacaaaaatagcaaggcctcaaattctcgtagtgctattcctgtaaagtgtcctttcacctgctgacagccagttggggagcaatgtttccaaggaatgtttccaaggaagttaaaaacacaaacttaggagctggataacgtggatttgaatcccatcttccccccaatagttgtgtgaccttcagcaaggctcagaatctccttgtgcctcaatttcttgatctgtaaagtcagaatagagtcacatctcatctcatagggttgtcgtgaggattaataatacctgaagcacttagtgtctgaaagatggaaagcatttcataaaattgttattattgctaggtgtcaaagcactgatggatcatcagtggatttaggatgctaaattaaggaggctcctgtagagtgtaattttctcattctacagaggaaataactgagactcagagagaagaaaccccacccgccacctttcacacaggttcattcagagagccagtgatgatctcctacacccaggcagggctcttcgtctgccttgcatacctgtctcaaagttcttgcatttcaggagcattcacccgaaaggagcttcccttctctcatttgtgagaagtggtagactggtcctaactgagtagggtttgcagggaatctttaacactacttggcaaagtagatactgatatttctagtgccttgttgagcatcctcaatatagaagctgtaagaggcccgactgcagtccccgaggccagtgtgtgcacattagcatccagtcaatgcaatgactcaaagggtgattatgtccttggcacattagccctgcacctgcctcttcctctctctttccaatgccctttgatcatttactggctcattgaatcttcccccagagggtgaagaaggaagaaggagcctaagtcaatgatcagtcagatattggtactagttagcaagtcttaccaaaccttctgatgcaatggctagatctgcactcctggaccccattcatatggccatttgagaggtgagggatgtttccataatcacaagctagaatcctgaattggaaggcttcaaatgctaatgctgctgcctattagctatgtatatttaggtaactcacttcatctcactgagcctcagtttcctttcatctgcaaactggatataataacagtacgtaattcaaaatgttacaagaattaaatgagatgataaatacaaagcatacaatacaataaaatgcctggcacatagcaggttctgaatacatgatattgaattaattttatctattattaatagatttaaaaatttttaaatatgttctggctaatctgtgcaccaaacccttagggtttgcagcttgtcactttttccctgctaacccctggatggtgttggctgcagggaggaatcctttgcaaattcctcaagcagattcttgtttgtaagcacattggaacaaagaggaacaaaataaaaacttggatttggaaccggaatatttctacttgattctcgtggttctaacacttcttagatgtagcatcatgtctggtaagtcactgaacttctctgagactcagttttctcatttctacattggggatgatggtgctccctgatttgccacctgaaagtgagcatggggcaaggttcattgctgtcattcgcatcattgttattagaggaacacactcattattattgagggctaagtatgagccacgcatttaaaatttatctaattttatgcccatactgaaaagtcagtgttaattattccatttacagatgcagaaattatggcttataaacaaactccttaaaagacttctatagatttttgtgatacccatctgcttaaactccgttaagtcttgcttgtgttccactggctgctaagatgctttttaatgacattttattatttgttatttgagaacatgtttatctgtgtgaggtgctcaagccaaggaaagggttatctttattttggcttccctggtaccacccagggtgccttgtatttaacagataccagtaaactattatccattgtagtagaaaacttcaaggtcaaactaagggatgcagaccagtgaaatatgctcttgtaatgtgaggaacatccattcagaaaggcctcttttgaaggggaaatgtgattatagagatgcagagattatcaagagttcatagaaggaacccaggtgggaaatcagacagcaaactggaacatattcctgccttcataatgagggagaaaggaaattagtgatgattctaaggtggcaaaggtcctgatctcatcttttatgatctgtattttgccagaaaaagaaaagaaaagaaatgtggacaattaggaagtaattaagatctcacagaagtatctacgacagaaagcagttaaggaaatacttagggatttgggggaaaacacaaattagcaggttggacagcacatatcctaacatgttccagggaagagctaatagagttactgaagcacttaatgattatttctgagaagtcactgaagaacagcagcagaacatacgcttaaattttttacaacatcaaatgtcatattgatcttttagacagaaggggaaaaatacatgaaatagaagctttaagaatgaagaaagtgggggaaatacttgcaactgttatgtggcagatattttcagatatagcaacccattcaatcgtccacttgtaagccagccctggattcttcccattttccagactaggaagcagggcttaggatggggaagcaaatcatccaagacagccactaatcattgctcgagctgggattcaccccagtctctgcctcatgctggcaggacccatgtcttgccatttttattgctcttctataacaaggattaacaaattggacacaacccaggaaaacaaaagaattatgaggctgcataagggcagggttaaaaaaaaaaaaaaaaaaaaaaaagcacagatcgcagcccgcaaacatgagagcttttcaatagaattacaaagacaatggatgaaaagatcacaagatgacttaatctggaccacaataactcaaaaatgtttctcacaaaattaattcaaatggactgggagaggctgcatagctgcaaggcttgaaaattaactcaaaggcagtaaacaaagaataatgatggaaataattcaaatacaaaagaaggcaccaagtctggtagagctcaaagccccttgcaatgtcattttattaatcctcctggcaaattgacaatgcagcaggactgggagaggtatagtcttgctgaataaagcctcattttgagacctggggttaacagaagtaaggtacaaataagggctagtttctcaccaggagcacctaccaaaggaaaagaggagctgtaggcattgcatgaaggagaaataatccaggttgaccagaagcctgactatctggacaaaccgaatactgtcaacccagaattgaagacccatcatttcagatcctgctcagcttctgtggttccccaccctgtctttttccagttgactcagctaccaagatcatctttagaaccaatccttcttcctctggatctccctaatcccaaatccttacctagactggggtttacttagttagtactagatcaaattccctcccagcacgttcagtttcaacaagaaacatcctcctgtacatgtatgcaccacacactgttagtttgtaaggacagagagatggacaagggaagagtccttggcctgccctctagggctcagtctggagggaaatgtctgggccagagtttgcatggtatattcatttaaccttgcctgaatttgtgtttggaaggtcatcatccttcacaaaagttcaagtttattctccaagggtcaaagagttaacaaataccacagtccagcattcaaaactctgtctctctggcacaaaagcccatgttttctccatttgactacacaaagctcatcaaagccttccacaaccaatgtctgtaccaccagttcacagtcgtaggtcaaggaaaataataacttccacgagcaagcatttattttgtgccaggaattttgtttaacacatgatcttatacagtcctcataaatcctattagagtcatcattaaccacgtattgcacgtgaggaaatggaagttcaagaaggaaaaagtgaaacacagcttgcaagtacagaagcaggagattcaagctcaagtccatctgccctacagactttaagcccaccacttagtgaggatgtgtgtgagtttcccattgctgctgtaacgaatgaccacaaacttagtggcataaaacagtgcaaacagttttgcaggtcggaagtccaaagtgggcttttgtggggcaaaatcaaggtgtcagcagggctgcattcccttctggaggctcttggggatagcccctttccttgtcttttccagctcctagagtttcattccttgtctcctggcaccttcctcccacttcaaagccctcaagtctctctgtatgtctatcttcacatccccctcgatgagtctaatgccactgcctgattcttataaggacacagtgattacatagggcccacctagataatccagtataatcttttcatcccaagatctttaacctaatcacatctacaaagtctctttttccatatggcatagaatattcacaggttagtaaattaggatatggacatctttgggggaccattattgagcccaccacaggatggcagaagcacacttaactgtagtagaaaccctaataagctcattttgctaaagaagacactgaggttcatagaggtaaagtgagtactttgggacatgtgtaagtggcaagataggaatctgaacccaaactagtacaatatcaaactccattttctccccttcccatagtatgtcgcctccaggaaaatgtcagacagataaaccatttggcactttcaaatggataaatggccaattcaaaatgaataatccttatgaatgattttaagacagatttggtgattctctgggttgatgggagtagttgtaggtgatctgccactttgcattttaggaaataccaagaaatatttaggggttagctgaatgttgataagtgtgacaaaaggcaaaatttttccttctcagcagccaggcaaagcaggatttgtgggaggagcgaagcctgagctaaatagactagatatggattcaagctccagatcttctgactgtagtcacaaccaggctgtgtcacatttctgggatcagtttctgaactggaaaatcggggctatgatgttttcttgggaagaaaaaatgagataatgcctgtgtggtgtccaacattgcatctagcacatcataggagctcaataaatggtaggcatttttattttctctcctctgtcctgatttcaggttttagagtaagaaacaaagacatctggcctttgtttgaagacagaccgctagctgtgcaactaatctttaaaaaaaaacaaccactcccttctcttgcctatgctcaaggtacagctgagagcttagaaactccaggcagacaaacgaaggaaggcaggtggataaaggaaaagctcagccatccatcagaccaagaggggataaatgcaatgcattattcagggagttcagtggtgggcctctgctaggaatggatgagggagttggagaggtcttttgaactcctcgggatttggccgaaagccgagagaggccagatgccacagcacctattagtcagctgttggccagcccttggcgatccactgggactgtttcaggaagcccagggctctgaatagggcaggaggttaaccaagccacctccccattctgcaaagccttttctaaaaccctgttttggaagctatgcaggcactaaactgcaggaaaccaggcagagaaggcccttggggcaggacccgcctcacctgtaaacagaattgctaatggcttgcagagggtggtttgactggtgatggacagcatcctgaacccataaacgtcccatgcatttgttgccatatctaaaattacaccttgactctctgagtgtaaattaggatcgctttttaagagggcatttcagcaatatctatgaaaattaaaaagtccatatttttgacctcataatactgctgctgagtaacttacagaaatgcacatggcaagaagctatatataaatatatatatataatatatacacaaaaaagttcactgtagcatacttttaataacataaatgtccatcaataggaaataaattatagtaatcaatactacagaataatgtcattacaaataatgatatggatccaaatattctaatgttgaaagatttccaatcattttaaagtaaaaaacaaagatacacatacaagtgtcaaaataatagcgcaatgattctgtattggaggaaatgacagatgcatatttggatttatccatacatgtggctataattaaagagaaaaataagtgagaagaataaacacccgttaccagtgatagtctctgggtaggaaagtgagaaaggggatgcagaatggaactatcactttctaccccacatgattttgttgcgtttatatttttataaaaggaatggctttatatgttaattctgtaattttgaaaagtataaattaaacaatgaaattcatttccacaggtgatgagaacaacaaaaggcttggcaggtaggttcacatcatcatttctcagatgggagagcagacaagacagaagaagagacctgtctaacatcacagagtggggtcagggagtagatccagggctcctggtacctagtccagagtgtttccaccatcttcaaggtctagatctttgggtgtccatgttatggaggcagatttccactggatagcaggggaactttatatgacacaatacctgggaataatgtgttgtggtggtcttgttcaggatgctatctctgccactggctggcctgtggcctcggccaagttgcttttccacactgagcctttgactccttatttgcagtatgaagaaaacaccattctcagggagacattacgaacatcagttgttccctttcctccttttcaacaaacacatatccactgcccccttcttgggaaaaggtgggagaaaaccagactgagtgtgtcttaaaactaggggttcaagtttctgctctgtccttgacccaccaaggcagtgtttaagaacctctggaaaccttctccacactttatccctcccaaattctctgaatacctttgggtccttcctactcatcaaggggaaaagtaaatatgtcttagatatgttttagatctgtgtccccacccgaatctcttcaactgtaatcctcagtgttggaggtggggcctagtgggaagtgattggattctggggacggatccttcatgaatggtttagcaccatccccttggtgctgttctagggatagcgagttcttacaagatctggttgtttaaaagtatgcaccacctcctcctttgctctctcttgctcctactcctgccgtgtgagacgtcatgctccctctttgccttccaccatgattggaagcttctagaggactcctcagaagcagaagctgctatatttcctgtaaagcatgcagaactgtaagacaattaaacctcttttatttataaattacccagcctttggggtacttctttatatccatttgaggacagactaatgcagtctttgagtcaaactgctgtcatcagaaataaagagtttgatatgcttccccaccacgacagtctagagccgggcgtaggcagcgaaaaaggcttgtgaggcaagacgccccttgcaggagcaaagggacccggtgttcatttcggctggtgaggagagttactaaactaccacccactgactcagggagaactagccccaggtttatgtagaagaggcagccttgacaaggtgaagtgatggtgactggctggctccaaaaatctctctccagtcatcctgccttagatgactggaactccacccttaatccttccagttaagccttcgaaggcctccattagcagtgtaaatgtttctcttgggaggaataataaaatgtaattgaagtaaacaaacatttactgagtttgcttcaaaccaggcacttgtgagccatggcagggtgtccaaggatgaataagatgctatcctgtcctccaggagcatgtagatcattagaagcactgagatgtatgccaaattacttaaaacgagagagaaaattcaaaagaagataaaataagaagaaagttccataattgttctctcatctatatattttatcagagctggatgataggatttatcaccttggggaatttccattaacatggctgaaaagtttgtactttatttggaatataatagatagctatggatattttctgggtgaaggggagggagtggcatattttttaaaatagtactttacaaagatcaatctgacaactctgtagaagatggataagaagaatcaaggcaagaatcaggagaaaaacatgagacactaatgtgaaaggttttagagaacgagaaacaacaggatgtgagaggatatagcaggagaaggtgggctctgaaaaagatgaagggatccatttatgtttttactccacagtacttacttcaggcaaggcaccgtgctggaatctgaaaatacaatagaagggttctaccttccttgagcttagagttgagtgtggtggtcacatagtaatcgagcatcataaaaacaaacgtataactcacaaagcatgataagttttctggagaaagagatcacaggatgctataaaagaatgatgaccaggccaggcatggtagctcatgcctgtaatcccagcactttgggaggccaaggtgggcaaatcacgaggtcaagagatcaagaccatcctggccgacatggtgaaaccctgtctctactaaaaatacaaaaattagctgggggtggtgttgtgcgcctgcagtcccagctactcgggaggctgaggcaggagaatcacttgaacccaggaggtggaggttgcagtgagctgagatcacaccactgcactccagcctggcaacagagcaagactcaaaaaaaaaaaaaaaaaagataacctgctctggtcaggggtggggctgctgggtacatcttctttgactgaagtgatatatgatgtgggtctaaaggataggtaagcatgaactaggcaaatgaggtaccacttcaccccactagggtaaagacagacattagcaagtgttggtgaggatctggagcaagtggaaacctagtagctgatggaaaggtaacatggtgcagttactttgaaaaaccacttggcagttcctcaaaaacttaaacagaattaccatatacccagcagttccattcttaggtatatacccaaggaaaataaaaacctatgtccatgcaaaacttgtacacaaatgtttatagaggcattattcacgataaccaaaaagtggaagcaatccaaatgtccatcaacagatgcatggataaataaaatgtagtctatccatacagttgataaaaagaaataaagtgctgatagatgtttcaatatggatgaactttgaaaacatttctaggtgaaagaaggtcacaaaagaccacatattgtatgatttcacttatatgaaatgtccagaataggaaaatttgaagagacagaaaatagattggtggttacagcatggggaaaagaggagtgactgctaatggttgtggggtttctttggaggtcatgaaatggtctggaagtggataatggtgatagtggcacaagtgatatggcttggatatttgcctcatccaatatgagatacattccaacatgtatctcatgttgaaatacaacccccagtgttggaggtggggcctggtgggaggtcacagaatcatgggggtggatttctcatgaatggtttagtgccatccacttggtaccaccctcaagatagtgacggagttcttgtgagatatgatcacttaaaagtgtgtggcacctccccattttctctcttgctcctgcttttgccatattaagaagcctgctcttgctttgccttccaccatgagcaaaagctccctgagacctccccagaagcagatgccaccatgcttcctgtacagcctgcagaaccataagccaattaaacctcttttcttataaattacccagtctccagtatttctttatagcaatgtgtgaacagactaatacaacaagttcataattatatgaaaaaccactaaattttacacctttaatagggtgaattttatggtatgtgaattatatcttaagtaaaaagtaaattttaagaaaagaatgaatgaggtagagagggtaaaaataaggatagtgttctggtcacaagaaagtatatgtaaatgaccaagggagagaagatatggttcacagggagaatagaggtcaaggtcaatgtggctggagtgctgggagcaagagagagtgatagcacttaagtctagagctataggcagggcagatcatgagtaccctttaggcttggtttttgtcctcagaataatgggatgctgatggggaattctatgcaaggtaataacaattctattacttgggctggtcaacatgacttggagggagtcaagaaagtgtagagggtgcccagttgtaggagtccaagtgagaaaagcgaggtcaagagtgggtgatggggttggcatgtgtgtgcatggagggaacagagtatgactaggtgtggaggactagcattattctgagttcaagagccaggagggacagcaggtttgggaaaacagaacaagtctgatctgcagagacatttattttgcacctaatatgtgccagagactgaacaaggcattttatatccatgtttctttttatgctcacaacaaaccaatgaggttgattattcacactgtttaggacgggaaattaaagctcggggagactaacttgcccaaatgcacagaggtggtaggtggcagcatagggagttaaatccaggcttgatgccaaagttctttgcatctttgctctacactagaatgctcctaggccagggatggtaaatgactttcaacacacacccaactcgaatctattagtagtgactgctttggagcactgggttaagaccagttctgagctcaagcccaggcccagcaggaaaatagaccacgattaatcaggaatgaatgccgtgagcacagagagaggcagtggtggggaaagtgaaccctatttgccattcctgctgtacgagttcaaaggaggaaaacataatatctaggcaaaggactaaaaatggccacgtgtgaaccatccatatacacaatagatgactctcaaaaatattagactgagaaaagatgtcagaaacaaaagaatgaatactatatccagaaggcagaacttttttagtgaagggccagacagtaaatatattaggctttggggaccagagagtctctgtcactactcaactctgccaatatagagtaaaagcaaccgcagacaatacgtaaacaaataagcgtggctgtgttcaaataaaactatttttaaacactgaatctgaaatttcttataataattatgggtcacaaaatatcattcttcttttgattttctttctaaccatttacaaatgtaaacaccattctttgctcacaggacatacaaagaggcaatgagccatattttgctcacaggccatagtttgctgactcctgtactgtttgtatccatttatagcaggtcaaaaatagacaaaattaatagttagagatatcagaccagtgggtgcctacaaactgactgactggaaggaattactcaggaacttgctggggtgatagaaatgttctcagttacatgaatatatacatttgtcaaaactcactgaaatgtgcacttgagtgtttacatttcattgcatgcaaattcaacttcaatttaaaaagtgtgttgctttgaactgtaacacttgtgggggctgggggtggggagaatggctgcctggaagagatttcatttgatgaacttgaagaatgaattcagcctccaaagtcaggagaaatatattgaaggcgagtagaggtaaaattcaatcagggctcaaatgctaacagaaagtggaaaaaatatatatatttaacaagaagccatgaaagtataccccaacccacatgcctcattgtccaaaagctccagctcagaaataattgctttgcacaataatttggagatgcagtctgggagctgatacaaatggagccgggtgcaatttggggagatttgttacgctcagctcccttctatcaattccagctgctcagatgttcctaacctgttgcttggcatattgtaacaatggcttttatttactgcacttccattaaatgatgaaatccacgaacaggggctcacatggcagaaaatcaccatttacttctccacttatcttgtgtcagcagccaagatcttcatctcggctcctgggatctggcttcagcagccagctgcagtgctacctgggaatatcggtagagcagctcaaatatgggcggtgggactgagctgctgggcggggttgcgtgactgcaaatcatagtccttggaaggtgagcaggcagtgtggccatataggattatgctgggttgccaaagaaagagatggatgtacactcaggttttacccagaactcaaggtatcttgggaagttttgggaaagtgaggtggttgattaggagaaatattggatgggatgttgattcaaagacaaaagcgaaacccaagataaccttcacctgagtgaatcactggtccttttacagtataacacatctcggcctaaccaagccaggagatcttcactccaatgttagttttgctaccagataaatgactagagatgtgatacgagtcccttcccacctctgcactttgctctcccttctgtgaaaagaagttaaactgagtaatctatttcagctctaatgttcttttaatccaaccttggttctcccactaacttgataagtaactctcagcaagtcatttcctatgggccatggcttccacatgatacactgagagggttgactgtgacaatcttgaaaggccctcccaggtttagagctctctgatctcatctgctaagactcagaacatttatctcgttgattttgtcaaattgtactttggggttagagttgagtatacatcattcttcccaatcctacttcaatccctagcaaagggaatgggtggatagatgggtgaatggatgttggatgaaggggtggaagggaggataggtggatggcaaatagatgaatcagtggtaggatgatcagatggataaatggataaaagggagtttgggaaaactggagaacagataaatgggatgatggaaatccacaacaaatacctcagtatttcctttcctgtccatagttcagttccagtgtactgagtacccataatgatgaactccactatatatagtatcgaagtttttgatgctttctggattcttcacttcaggaaaaaaagaatcataacattctttttatttcaaagtatgcacatgaattataagtacacatcatgcctattaatatattaactgtgaaaggaacataagggaatatgcctcgaactcctggcctcaagtgatcttcccacctcagtctcccacagtggtaggattataggcataaaccactgtgcccagccataagggaatagattatcccttcacctactgggaaccataactcaaactcaggaaaccatacagtgttaaaaaataaaataatttttaactgtttctagagtatgtggtccacccaataatcattgaatatggattttagacagagagagatctgtgagaacaaggggaggcaaggggaggggaaggctaggtggaaaagatttcccagagaagagccttgaaagatgggaatgaaacaggcagtcaggcaagggatgagtacagacaagagtgaggggatgcaggagtaggaggataggaaacattgacaactgcttgatcaagaccatggggtggcatggttgggtaaggactgttcagctcaagcaagcatgcacaaatctctaggcttctgtgtgcccctaggaacgacagagggaagcagggaaaaggaggggaggaaagagaaaaagaaaggagcaagagagaggatatggaaagagtgataaaaagggacaaaaaggaaaaaggagagctaaactgagacaaaagaagagagagaaaggagtaaaaaattctctgcacctaggagttatatttcatgatcaaaagaggatgaagctgggggtgaatttctggtggcagcagggaatgcccaggaagctttggggccagccccaaaggggcaatggtgggggatgataatagatgaaggggatatggtaccttgccaggaaggcccagtgctcaggcaagtggggtccctggaaccctgtccctttctccactgccagctctaagttgctaaggttaccttcttaactgcctaattagagaagctgtcactctttgacaaagatcaggaggaaaggaggggaaaaaaaaaagcagacatttcatactcagacaagaagaaaataataaagccagtcccactggctttcacatagagtttcatagaaactctgccagcagtcaaagaagactatatctttatgaggaccaccctctgttactagtttggagagaactggaaatgcaccgctattcgcagttaacatggagcagctgacagcctccaggttaaatggagtggaagacatgcgagtcaggaagacatggatatgtacccattctgctgccatggtctgacaagtctcagggacctaggaacatggtgctcttcttagccagcaggagctaacctcagctgatcagccttaatacacctcaggagccaccattctagggccaacatttcagggaccaggatggaccacgagctgtctttggactgcagttctgggaaggagagctgaaaaagacatgggaggtgaggtggagctggaaaggggcaggtgcaggaagcaggaggtaagttctgtaaggtcctaggacggcaaggtcccaggtgaatgcctccctctctgagggcagagtgcatgccactctggaatgccagctcctcagccccttgggtgtcactcacccttccggactatgaagacccacatgtgctgcagcaccctccttggctaagctcctgctattttcctcctcctacacccacagagcttactactttctccctaggagaaagaagagcaacactttgtgttgtaaaagaaagcccattttcactaactccattactctatgcaagaatgggagaagcagaacagcagtgggttaggggccagtcctgccaccaacaccctctgggaccctgggaaggtcccttgacctctctaggcctcacagtctacaccctgttgatctcctggggttggctgtggattaaacaggagaataggaaagttcttcttaccaagaaaatgagcaacacaggggcttgtatctatatactattcagagattcatccccagcttctagctgagcacctggtatacagaaggtgctcagtatatcctcactgaattgaaacaataatttaagtacactatattctgtatttatttcttccttcaacaaatatctttttaatacaaaataaagacataattcctatcttcaatgagttttcagtgagtgaatgtagaaaagacaaacatcaaatagaaacaaatatataattaaaatctgtgattaagtgctgccaatagcaggaacttatatataaaacagggagactggctctaactaagaagtcagagaaggcttctctgagagagtgacattaacttagaatctgaaaaatgagcaggagtcagtcaggcaaaaaggggtagaggcaagatgtttccaggaactagaaacagcctgtgcaaaggccaagaggcagaagtgggtctgttacattagtgggaagataagatcagcagagatggaaaagcaaagaatcacagggagaatggcaggatacgaggctggagataaaaacagagcttgaaccagaagatccacaggcttcctagcatcattcccctaaggcaaatcctctttgtttctggagagaaatgcggagtcctgacttctggacgtgggttgtggcatgcagagcaggccacaagaaagtcatcacttttgccaggcacataaagattatgaaatcctaaaactacttccatgatcaccctcacctggtctttatagagcccttgatttgatgctctgttttgctgcaaaggctagagctgaaaggggccctggagatcatagagcctagtggtatctcactgtacttcacaaagctcaagaaccacttcagaaaggggaagagaaggcctacaaggaagggctttgggccccttcacccttccctcagccagagaagttcagctttgctctagtttttacagcactcttcacagtggagccatccaagattccatttgaagaaaggctttgatgacaaaatagggattttgaaaaccactaccattgtgcaaatgagaactctgaggtcctaatgagcacatgtcttgctttttctacccaacaatattttagtattgattcctagacccacctttcaaaatctacctcttctccatttatgtatatcccagacggaacatcaatccaggtatcatcttcttccctagatgagacatatatatcaggccaccctgggctaatgagactctcccaagaattctgaattccggtgaggtcatgggagtgaggaaaggatgacagacacttggatctccttcatcctagtgggagtgctctgatgagactgtgtgctggttattgctcccaagatccccagagcaagctccttcagcaattctatccttccatgagccatcccaaatagaaatatttggatatttcttaaataaacagagttggcttctattggttgcagaccaactgatagaccctgtaatctatggatggcttggttagggtgctcacagagttgggagtgtagccaagattagaagtcagagctcttcaaccacagcctgtgacggcctgggctggtgactatttgcaacctcatgttagctgggtccttaatccctagaattctgccttgtcttcccagcctctttccccagagtctcatgaagagtaaaattatatcctttctatatcctccaacagaattcacaggctatcttgcccttggggtccttctttataaatatgacatcagtcactcctcattgaccataaaataatttattcaatgtgcaaagaaacaagtacagatattatgccaggatctggatctcaagccaaacagaaacaagatgaatgtttaactaatccttactgtgctactccaatagtatgcgtgtgcctttcacttcaacctgagcaaggattaaagaaatcatttgcaatataccctgcttcagaaagcacctgtgaatgtcctgggtctacatcactcttccctttgctcacaatccaagcaggttaatttcctatatgaaagaagctgcaaagggggtgggcaagaggggagaaagggcttttggtttttcttctttaagcctattgactagagctgcttccaacagtagcagaagttgctcccaaggcatttgaaggagatgggaacacacaaacctaattgcattacactgcagcttgaccaagcgatcactaacttgattgcagagaaaggaaatgaaaatgacagagacaaattcaactcaaccgttctcttacttaaactcaggactcaggccaccagctggaaggcaaagggaatagaggcaaatgctcatggataattgaggaaattatttctgtggtctgtagcccttttgaaggagtggaagtagggtatgggcaccctttgtcttacctacctccagccatttagctcttccccagtggtctactcagacttgacactatggaggcaggaagaaggaccatattcgacactggtatctatccatttatttgctccttcactcattcattcatccagtgaacatgtactgagtactaattgtgaaccaaatgcttggagaagcactaggtatgcggtattgaaaaaaagagacaaagtccctgtccttgaaaagtttagtctggaggggcccacagacaattaacatgaacagatacccaaatgcaatgtggctactgagtgacaaaaaaaaaaaaagaacagggtgttgtgagaaagacagtgtattcgggggtaggtgaacatggactctaattaggatggaatggccagggaggccctctggggtctctggaaagcaaaagaaatgcaccatgagtgaaggtggaaccaggccaagccttgacagcagtggctctcaacccaggttggcactttggaatcacctaagccactgggagagattacaaacaaaaacaagagaaaacagcaatgcttgggaacaaccctcagttattacaatttagcctagggtagggcccagatcctgagatatatacagatattttttaaattaatagactttattagttttaggtttagagaaaaattgatgagaaagtacagagaattccaatatcctaactctcccctccacaaacagtcgtccctattatttacatcttgtgttagtgtggcccatttgttataattgatgagccaatattaactcactgttattaactacagtccatggtttacattagggttcagtctttgtagtgtacattctatgggtttgacaaatatccagtaacagatgttcatcattcctgtatcatacagaatcgtttcactgctctaagaatcttctgtgctctgaccctgctcatctttccctccctactagtcctgacaactgatctttttcttgtctccatagtcttgccttttccagaatgtcatatagttgaaatcatatagtatgtggccttttcagattggtgtctttcacttagcaatatgcttttaaggctcctccatgtctttttgctgcttgatattaatagctcatctatttttatttctgaaaaatatcccattgtctggatgtactccagtttgtttatccactcacctcacaacagacatgttggtttcctccacattttgacaattatgaataaagctgctataaacattcatggtggacatgagttttcaactcatttgggtatatacccaggagtgcaattactggatcccatggtaagagtatgctttgttttacaagaaactgccaaactgttttacccctagttacactgatttaattggcctaaggtagatcccaggtcctggtatttttaaaagcttcccaagtataattggtcctccatatccataggctttgcatccatagatttacccaaccatagatggaaactcacagaaatggagggtggactggactaattttctatctgaggttagttgacttggaggatagggaaccctaggaatctgaggggccaactgtaaggatacggagggccaactgtattctaagggacagctaaagctgaatatcttgtaggccttgattaggaaccatgtatttcattataagcacaatgggaagtcatcatgaatttaagtatgagtccattttcatgctgctgataaagacatacccaagactgggcaatttacaaaagaaagaggtttattggatttacagttccacatggctggtgaggcctcacagttatgtcagacggcaaggaggagcaagtcacatcttatgtggatggcagcaggcaaaaacagcttgtgcagagaaactctcattttttaaaagccatcaaatcttgtgagaccaattcactatcatgagaacagcatgggaaagacctgcttccatgattcaatcatctcctactgggtccctcacaacacgtgggaattatgggagctacaagatgagatttgggtggggacacagagccaaaccatatcatttcgcccctggcccctcccaaatctcatcttgtaagcacatttcaaaaccattcatgccttcccaacagtcccccaaagtctcaactcatttcagcattaactcaaaagtccacagtccaaagtctcatctgagacaaggcaagtcccttccacctttgagcctgtaaaatcaaaagcaagttagttacttcctagatacaataggggcacaggcactggttaaatacagccattccaaatgggagaaattggccaaaacaaaggggatacaggccccatgcaagtctgaaatccggcagaatagtcaaatcttaaatctccaaaatgatctcctttgactccatatctcacatctgggttatgctgatacaagatgtaggttcccatagtcttgggcattcattataagcacaacgggaagtcatgagttgaagcagagaagaggcatgatttgatgtacatgtttataaagtcattctggcagcatgtgagaatggattgggaaggcctgacgggggattaagagcaagacagaatctgagagaccaattaggaaactattgaattataggtcagagttgttagtaacttatagcaaggtagagatggaaagaaatacatggattcaaaagctacattgagagaaaaatcaataagctttgatcataggttaaacattgaaatgaggggaaacaaagggagaaatccaaggattacaagagatacttctaatccttctctggaagcaaatttaaatctaccctgcagataggcacaaaggttactagcttattttcttttctgtcatggtcttcttttctctttcttctttgttttgtactgtttgtttgtttgttttgtttttgaagtaagagctcctcttaataccgattactattttaagggattactaaactcttacaacctaattgggcataggcctttaaggtcaaactcaatctcctttgcccacatcagaaggctacatgatattttagggatatgttagcttagctcaaatgcttttcattgtcagttacaaccaagagttgaaattttagaagggatagtctcttaagagagtttatcagtcttggaagttttcttctgaaactacccagcagatgtttccaatgccctgaggaaaaaggctttaagaaagagctggtgatgaatagtgcaagagcagcagaggaggttgagaaagaggagcccaccagagttacagaaaaagagctttgcaaaacaggaataagacactcaggtctctaccagctgctctcaaaaacccacctcacattaaaaatcaaggtcatggacaaattggcacaagatggaccaagtggtcatggtggcctctaagttcactcaggacatttggagtcacatttggtaacaggagtagacaaagaggctacctgtcaggaatgtggaggttctgacctcacatgaaagctagagctgctccctgaaaggccagcccctcctcagccaagaatctcacttctactctctccttagctgcaaataccatactggaatgtctgaccctgagcagaaggagccagctttaagctgcagatggcgccacgctggtcaacaagggactttggctggtttctctggttagggtaggtggacaggaaagacttgtgctcagagattctaaagagaacttgagattgttggggacagagagacagagactgagagaaagtgatggaaagacagacacacaaacacacacacagatgtagagaaagaggagaaaagagacattaaaagtaaatagaaagcgagagaaaaaaacactaaagacagaaaagagaagaaatttaaaaagtggaaatggaaaggaaactgaggaaagcaaggaatgagacaaggatggggaggagaaaagagaggagagcctcttgcattccattctcgtgccatcactcacacgggacagttttcaggagttctctctggaagaaacactcataaatcttccataaaacaatgatgaaagaaagctcaaacctgtgcattcatgtcagacagttccatccgctcctgtctcgcagggactgagagctcctgagaccctcttgctaaggcctaggaatgggcaggctctgaggtggaatgggcaggctctggggctggataagcagactctggggtgcagtggggagactctagggtagaatgggcaggctctggtatgaaatgggcaagctctgggatatggaggaggaggaggagatgggaagggaagggatggctgagaacaggcccatcaagggtccagaattcctactggtaagtgtgattaataggattcatctaggacatcctggactataagatgcaccagactttgcgaatgcaagcttatgatgcaatatttgtattagcaacccttggtgtcttttcaaaataaattgccttaaacttgcattttcaaagtggatctctttggggttactggttacagtcctgtcatgaaagtcagtgctaccaacattaattggtagcacctattcaataacagattctgtaccaggcaacaggagacagaaaaggcaagagtccttccatcccctcaaggctttcataggcagtgctatccaacataaatttctgcaatactggacacgttctatgtctatgttattcaatgtagtagccaagagtcacatgtggctattacttaaatttataaaaattaagtaaaatttaaaattagttccccagtgatcctaggcacacttcatatgctcaatagccacatatggctagtggccactatattggattttgcaggcagaggatgagataagagagagacatcaatatatcaatataagggaggaggcctaagaaagataaataaagtgtcctgaataaagttaatcaaagataaataaggcaaagagggaaagcgggaggagaaataaggaatgaatgtttctgtgaggaaagtagcttatacgaaacaggtaagttccaccagcagaaattcaggagaacaaggttgtccctgacagaggacacagctcgagcaaagtcacagaaatgggaaagtaaagcttattttccggacagtaaaaaccccagtttggctgaagtgtaggcaaaggaactgtgagagagacaagcaatagaggcgggttgggtccttatgcagaggactcagctgctagggaatttactcttaatcctgtaaagcagtggggagccactgaggattccacatgagagaaagacaacctttgggaatgattcttcaagtatctacttgaagaaagaaactgcagcagtagaaactgccaagagactgggagagtgatgagggtggtggaaacgaggaaagagcatgggggaaatgaggaaggaagagctgctactggattacaagacagaaagctgtatgggacccttatttctcccacaacaagaatggcatctaaaagtctaactatcactgtgaaaggcagatccctgaagtcatttcctgagccaatgtcttttcagaggcagaatcatccaagaaaggagtgctttctcataatcatttgtcagcccattaacctatatagcaggactccttccccaaatgccgcccccactgtgtcccctcataagccactggggcagggtgcctgagaattggatagaagaaaggaaacacagaagaaaggaaaatgagatggggagaagaggtctttaaaaaaacatgctggggaagtcaaaacaaattcccagccattcctgctggagattttatggggcgagacatccccaaaataggttttgaattatactctgcacctcataaaacacaggaactcttggcagcccgctcacacacactgccctcttgttacctgcccaaccgtccctaaaggtaggcatgctgggaaacccagtggagacaaaagaactcaaggctggtgttctgagttctgtgttcataagtagcctcactcccttgacgtcaggaaatgtagtagccttctcccagcctttgcctccctctgtgcaataagaaagctggatgtggccagagggccctggagttgtgaatttagataatctggggaattggggtgcaaatacgcagagttacacagaacccccatgaaaccatacatgtacaaggtgagggcaaaaaggacttgaaagagaatgcctgttgaggtgtggtcccagatggaaaaaatatttgttaatgtttaattattttctaaaaatattgaaagctactgctgaacaacaacaagaagaatctatagaacattcctggtctttgggaagtcagtgtgatctgggaatttaacagcagctctaacatgctcggcaactttactattggaaccacagttttctcatctataaaataggggatagtgtggggtgcctccctaagaaggccaccccaaagcatgaggacatcaatggcaattgctgaggaatcctaggaagggttatgaactacaacagtcaggagttcctggctcatctctgggattctgtttcctcctctttaaatcagaattttggacaaatgatatctaaagcctcagccactaaaactgctatgacttaatgcctctgtcaacctgaaatgtatatatttcaaaagcttacagctggccttctttccactgactgccagatgagcctgcgtttcatgttatctctgtagaacatttcgggcctccccagctatgaatgcttacactgctaaagtgctgcctctccagcactcaggactttgccacccgttaagttgtattttacaggaagccaatttgttttccagacctgcttatgctcattatatttcttataattacaaaacttaaagaaatagtttactttttattttttatttttgtgtgtatattgtaggtgcatatatttatggggtacatgagatgttttgtgttgttgttgttatgagacagagtctcactctgtctcccaggctagagtgcagtggcctgatcttggctcactgcaaactccgcttcctgggttcaagtgattcttctgccttagcttcctgagttgctgggattacaggtatgcaccaccatgcccagctaatttttgtatttttagtagaaacagagtttccccatgttggcaaagctggtctcaagctcctgacctcaagtgatctgcccgtcttggtctcccaaagtgctgggattacaggcgtgagccaccacacccagctatatgagatattttgatacaggcatgcaatgtgaaaaaagcacatcatggagaatggggtatccatccactcaagcttttttttttttttttttgagggggagtctcgctttgtcacccaggctagagtgtagcggcccaatctaagctcactgcaacctctgcatctcagattcaagcaattctcctgcttcagcctcccaagtagctgggattacaggcatgcaccaccatgcctggctaattttttgtatttttaatagagacggtgtttcaccatgctggccaggttgttctccaactcccaaagtgctgggattcaagcgtgagccacagcgcctggcccatcccctcaagcatttatcctttgagttacaaacaatccaattacactctttatttaaaaatgtacaaaacttaatgaaatattctgcaaattaaaaatttatgaacatccaagaaagtggtttctaggaggactaagttgattatactatttaaaaaaaacaaagaaagtcacttaaatattgctgttgaattaggtcaggtgcgacaactataaaaatttagaaaggaatcataaaactctagaaaaattacttggcaagcatctttaggtcctcagtctcctttaatgaaaccaacactggagatcatatctggtgtattatgagcatggtttatggaagacagatggcatggaactccaatcagctgatccagcctccaagaggcagccttgggcctacatctaataattggcaaatgtatgcacatttacgtattttaagttaaaatgaaatgtttacggtgcgtctattactttttatgattctccactttaatggactttttctactaactgaccaactgccagtctaaatggcttcaaaaacaaggatttctagggcaaggaattaaaatgaaatgtagttagccctcccctgaatagtttgtctccccacacaaatgagaagtttaacgaagaagaagagaagcactgatttagcaatcatgtcaaatgccatgccagagacacccacccccgacaggttgtaataactagtccctttctagcttctcctttgctgagttcagtttcttctacttctcctgacagaagaatcatcatattccacactctctgtgtctcatatgtatctgcatgtatgtatgtatttgtgtacatgtacgaatgtttctgttacatattatgtatatgtgtgtgtgtgtgcatctttatgtgtaaatcaagcaaaggaaaataaaaaaagaaaattccctaagacctacaggaaatcttgagatagtttcaggggcctgaacattctaggggtggtttgtaaagctggcttaatgttaattataagacggacagtaagattccttcaatcacactaccaccaaaaaatgtggaaggaacattaaccatctcctttccaatatattgtacatggagaatggaggccgatgctgtggtttggacatagtgccatccttctaaaatgttttttaaatgtctaaatgcatgttttgttcagatgaaattgaagctccaatgttacaggcagctaagagtggagcacctctgtaacagaaatccagagcaactcatactcccctgatctatcatggaggccagctatagaaaccagtgccctaatgaaaagacaattttatcaatatctctgtgccgcctgcaagaaacttcagaatgaccttggacaaatctcttcccctctttggcaccaaaggtggctattcacaaacatatctattccacattcccataagcattccagcaaactgtttgtcatggccacctttgaggaatgtgtttgggtggaggagagactttcaggttttcctttacaatatctccgaattgcattaatgtgttacaacaaccttgtattctttctgttaatattttttgagatggagtcttgctctgccacccaagctggaatgcagtggcacgatcttggctcactgcagcctccgcctcccgggttcaagcaattctcctacctcagcctcccgagtagctgggactacagacatgcgctgccacatccagctaattttttgtatttttagtagagatggggtttcaccacattggccaggatggtcttgatctcctgaacaccttgtgatctgcccacctcggcctcccaaagtgctgggattacaggcgtgagccaccgcgcctgacccaaaatgtaaaattgaggttggaaatacaataaacacacgtgtactctctgctggagttacagatattaaagagaaatgatgtttaacttagaaagcttacatactaacaagaaaggccgacatgcaatcaacaatatttctatgaaaatactgactgcactgaatatacgaaatgcttgggaaataactgttttggggggagccaggaaagtcatcttagaaggagtgagggaatattcacgctggatcttaaaagatggtagttatgaggcagaaaagatatttttaaaatatataatattaaagataatctgacatttaagtgagcaaaatttgaattttagaggactatcttcgtctctgtgcttgggtcgatcaacattttccaagtattgaaccagagatgaatttagacggcacatgagtgttttaacttcgatagagacatacttacttttgcaggctatcttccatttactgaaagttattttggtgtttcattcatgacagtgatacaaagtttcctttttaaaataaatacagctaatcccattactactgaccttatgcaataagggtctatgagcaccctgcttttctataccactagagatccagcacagggtctgggatggaaggaccactgaagaattactaaaaggtcttaacaccaggcagagatgccaaggttttcgggttgaattggtttagattaggaaatgggaataaaattcatcccctatgctaatcccaattgactggaagtgattgatgaggcattgcattgagaaagaatctcaggctatcattaaatgattgattagcaatgtctgtcatgaatacagaagtggacagtggcagtatggccaaacataatttccactgattattcatttattcattcaacaaatatttattgagtatctactatatgatggacacatctgtaggcacatgggattctgcagcaaaccagactggatgatttctcctctctcttggagtagcctatgcagcccaatcttcccctgctttcctgaaagagacttggctcttacaatattaatcttccctgaggtcaaaaaaggactgccatttatttaaggtcacacaacaaatcaatggcagaaacaggactagactccaggcactacctccaaattcaacacagttgtgtacttaccagacttgaaaaacctgtttggttttcctagctctgtagctgccctttctcagccatcagtctttccacctgctgtccttttgtggggaggacagaacgtctgttccctcctggaagcagggaggcaagtgagtgggggcgattccctagaggcttctgtggtttggagagatggattaaagaggtcaggacaataaaagagagagagaaaagaggggagggagggacagtaggaaccctgccattggcagaccagtaattggttactttgggcagtccccctccctggggaaggctagagagaaagtaattgaagaagattccctgataaattagtgcaagactgggcttgaaaactctagtcgcacctgggttcagagctgagtgtttgatcttcagaggccccagaaaggatagagaaggaaaggagaaagctttaactgtaactccagcctcagaagttcccagagggaacccttctctccctcctgggctcctaggatcacttagtttaatctcatcacattagagatgagggaaagcctgaaaagaggaagagacttgaccacagacacccagcagaactgggaccaaaacccacgattcctagttctagtcctctccaccatattacactgcctctgggttccatgagatctttaaccacatgacttgcttcgagtgatcctaagctctctccagctgcaaaagaggtagggagggggctggtattagggattaaggtacaggcttatttacttttgtttatttaacgagcacataggtagcatgtactaagtgccgggtactgctgaacatactttataaactttagctcctggaatcctcctcctaataaaaaacagaacaacctgatgaggtagtgatccatcagaagtggtgttcacaaactatcaccctgatttctgcccattttgtcaggaaatatctactcagaacctactatgtgatgttcctcagctacgtagctgagggagcaaaatgatgaacaagacacactccctgcctccaaatacctgtcaggtaaaggcttttaaaaataattgagatagctgagagtgtggtgtataagggtgctactttggtccgggaagactacttggaggaggtaatatttgagttttgtgagcaagggaggaaatggtagaaggcaactcagagaaaaaggcaaattatttaggattttgcagacactgaaaaagaatgaggattttatcctaaaaacaatgagaaacaattgcaggtcgtaaacaggggagtggcaaaatataatttattttttggaagacatcactctggctactgtgtagagcagaggttggcaaacgttttctgtaaagggccagttaataaatattttaagctttgcaggctagacactctctattgccactgcttgactttgtcattatagaccataagcagccacaggcaacacataaacaaaggagtgtggctgtgttccagtacatttttatttataggtactgacatctgaatttcatatgattgtcacatgtcaacaaatattattcttctcttgactttttgtcaactatttttaaaaagttaatagtcttatgagctgaacaaacaaacaaacaaacaagcaattgtttagatttggcccatgggctatatatagtatggcataaagaaaggacagagaagggagaggcagcaggaagaccggttaggaggctgatatgggaaaggatggcagcttggatgaaggtgatgccagtggaaactatgaaaagttaattctgaaaatcttttcctgttgttgtttttttgagacagagtcttgttctgtcacccaggctggagtgcagtggcacgatttcagctcactgcaatctccacctcccaggttcaagagattctcctgccccggcctcctctgtagctgggattacaggcacctgccaccacacctggataatttttgtgtttttagtagagatggggtttcaccatgttggccaggctggtctcaaactcctgacctaaagtgatctgcctgcctccgcctccaaagagctgggattacaggcgtgagccactgcaccctgcctgaaaatcatttaagaagcaaaaccatcagggttagctgactgaaaggatgagaggcaaggaaaacgatgaagaatgactgcttagcttgaaaaactaggctaatagtttgatttcctgagatgggaagatgtgggtagagcaggtttagggggcaaatcacacatcaatagtgtgatcccagacaagaaggagagaaacacaggtttcctacgggcttctgaataaaataaaggacgctcagttcactttgaatttcagatagtcagcgagacatttttagtataagtatgtccaaaatactgcatggaacatacttatactaaacaagtattcattatttatctgaaatttaaatttaagttggcatcatgtatttttatttgctaaacagagcaaccctacatggagtggggtggggtggtggtggtggtgtgatggagggtatataggtctccaggaaaagaaaacctaagcccaagaggagaaagagaaggctccttagagatgacaccccttagagcagatgctagagctaagtctaggagctggccaggtgaacgaggaatacaaaaacaatctaaacagagagaagagaataagcatgttaccctcagacatttgcaagtaattaatgaggctagagcctcgagggaggaaaggaacattggaggatgaggctgaagagcttctaacagggcttcacttcacagaggttttctaggtaaaggccagggtgtcaatacacttgctgaagttcagattcccaggcctctccccaggagcctcagcaggtctggccttgagagcctgaggtctaccgtgattctgatgatcagctaacttgaggaaagcctgggttaaataatctgggaactcttccacctacaaatcctgggagccaaacaagttgctgctggctgtaaaagtcttgaaaagagtaattcagataatcagaggaaaggaagcattgaataagtgtgcagcctcccatggggaccctctagaatggagctctgtccatttggaggacaatagggaatccagaatgtttgtcaaaggaccagtcctgctcctgaatagtcaccctgtctggcacctggctctaatttggtgctatctcccagctctgtgcaagtagaccagacgtcttcctgtgccttcccccgatgccccacccccttccctcctccgccctcagccaccactgaaatgattcccccaaatgcagctattactgtgactggaaatctctttactgctgattctgctaatggaaatgttccttcccttttcggctgcttgcaaagccactcgtgacttccctgggtgcatgagagcaaggctttgtcagccagccaccaccagaagggagaggattctgccccgcctgctcccacaacacccacctgccttagactcagtctctaagagctcttctgtcccaactgtcctcaaacaaccccggaattccctgcttcccccagcttcccccagctccaagagaatgagcagacatcaatggtcaatttcatccttttttgccttgctggggaggaggggaggtggagagaggaggcataagaggagcatgagggagtggaaagagggggaggggaaaggaaatttacattcattattgattcatacctccacctccttccaaaaaaaggattccaggtggcgaagaggcacagagcccaagctgtgtgccagatgctgcgctaggtgctttgcacacactatctccataaggatcacacagcttagtgtaagtaaaaagttagcacagtgcccagtgctgactaaaatgtggttatggagggctctccaaaattaagtgactattatgttttcttcatgttattgatgggtaagcagaggctcagagaagtggcatacataaatctaaagctaggaattagcacatctgggatttgatcccagggcttttggtcctcagacctagcaaaagtctcactctagcacactgccaccatcagaggacctgagctagagacttggttgtgctgtggattagctgcaggaccttggaaaatgtatttgtcttcgctacatagatgaaggagttgggttggatctcaaaggcatcattttacctcattctaataatctagaaggatacactatatatttggatttatatagcattataatatattacgtatgtgtgtgtatgtatgtataatatagatcccacattcaaggaggaaacacgaaaactgcacaatgatgctaaggagtactgagtggaaaaatttgacaaggttgagcaggagtgagaagcaagttcacctagccagatagcggctacatctcagactccagacaccctgatcatttcccaaaaaaggacatagagcttatacaaatttctcagaggacaagatcactgatcccctagtaaacacttggcagagcatgaggtgacaactctctaagagttgggaggaaggaagaaaagggggaaaaaaaagaaggaaaggggatggggaagaaaggagggaaggtggaaagaatagagggagggaaggagagaggaaaccaagaaggcacagaaacataggagtttgcttgtcaagtgggtccaggagtaacaagaggcatctggagagtatgagacaaggcctagatgctgtcttggcaaagcagcaaggagcaagcaaaggggcctggggagctgctaagtcagctcctggcagcacagaacaaggtgctcagtcccttgggcctgtgaggctgtcacacctgaagttcctatataagaaacgcctgcagcttcttggtcatgagaagaggatgacataagaagtaaaaaagtctagagatgaaaagttgagagcatctcttgttctatgcagcatgcaaggcagacagaacatagactatggaaccaggcagacctggatttggactgagcttagctgtataatagctgtgtgatcttgggtaggttccttcactcctctgagcctcagaactcaccctataacatgggatgagctacatctgtccttcagcactgtagaaagaatagataacaaatgtaccatcatggcacctgggacatagtacatgttacataaaatggtcacggttttcatagcctatcctatgtaggatgataaagtccagttacattacaactctggaattccaactcctcctgtccccagtttcccagctgcccttccctaagatggaaggaaaacacataggggtcagtagatctgggatctggcatctgctttaccacaggcttggtgaccttgatttccccatctttatatagaagtgtttcagttagataatgtcctaaatttttccatttctgatatttgataatcctggaaccatggtgtatcatttccctgaaacttgtattgtctcttcgtttgctacaatgcaaagtttctaatcatttacctggtttccaagctgctcaagacagagtcttctccaaacacaatgatctttcctctaatcacattgttctcattagccatcctgcaatcaccccaaaataatcaggagacaggagaaggtagcagcaatggctatgggtgcttagaagagggaaggctctgtgggatggatagtgtttaggctcactcttaacagggtagtgcaaattcagcccatctcaagttttgtctactgtggattctgggatgacacttagcaaacacagagttctagttctctaagatctcctgtacacctacaatgtgccaagtaaagggtgagtcaccacagccccagagatgaaggaggtacattagctgctcacagggtacataggcaaacagcgtgagacacatgaggaaacacacagcgtaaattctggtctcactctgctccaagccaccattacttttcatcagtagagactccttcaggctttcctgcacccatcgttggtcctgtacagagcagcgtagggaattcttttgaaacataagtcagaccttggcactgttttgcttaaaattctacagagctcttgatttcactcagagtcaaagcccaaatcctgacagtagtctgtacagccctacatgactgttcttttcttctctgacgtcttgtcctgccacccccctcctccaccaccacttgttcactgcattccagccacaccgaccttcatgctgtcccttgaaaggtccaggtgtgctcctaagctagataatcagctaggattatctagctaggagctgttctccgcctggaatgtgcttttcctagatgctgcttggctaactccttccccttcttttagcctttgttccaatctcacattctcaataagctcttctcattctatcctatttaatattaaaacccgtctccttatctcagaactctcgattctcttttcccttagttttttcccttttccatagaatttttcatcttctcacatactacataacttatttacttattatgtctgttgtcattgtcccctaacacacacacacacacacacacacacacacacacacacacacaacacagagggataaaagctctctgaatgcagagatctttgtcttttgttctctgatgtatcctaggcacatagaacagtgactctcacatcactggtgctcagtgattcaaagggcctggctatgattatagcagtctttattgatagtgggcaccaaggctcagagtgttcaactctggtgcagaggggtcagaaaaggcttcaaaaataagttgacacctgaattcggtcttgaaaagcaagaaggaatttccccaggggatggtgaggtagaggtgccaaataagaaggaagggttcttagtaaaggacaatctggcagagtgtgatcagggaccttgtactactacaatagggagagggaaattcaacaccttcagaacaatggggaagcagtgaagtgctttacaagaggatggccattatcagatttgggcttttaataaaatcactttgtctgcaagtacggaggatggattagaggggataagactagaggtagacagatcagtgcgttgactgttgtaattgtagtagagagaagtgttgaggcctgaccttgacagtgactgcagtgctggggatgaagaagtagtttcccttcatagtttgtaacctacaacatgcttgtcaaatttcaactcacagacttggatgcttacatattccagtatgctagtaagaaagctacacatatttcagttttgaatcttgcattgtgtagtcatcacccactccttttccattcaaaagggagttcttttggggggctattgtccaaaagagctatagtcagtagagaaaagccagtgaaaggagagaacaagtgctagaaaatagaacaactctcattgagcattgctgcctgcctctttctgggggcagagaggctgtctgctccattgcaaggaaagaaaaaccagctctctctctctcactatagttaatcttttgttgccactagctggtcagtatgagaacgtgggagagtatcagctctggaaaggaagcctcctctaatgctgctccaccccaaggttaaacccgactctttttttcctttcctgaaaagagcagatttcctccacccacccccaaaggcagctagggtgagaggcagtgaggcttccttctgccccagaacaaaacccatcagcccaggtgcttaggatagattggagccaatcagttggatactcaggcaggaaaaccaattcaatttccctaaggagatttttccttgtagattttttttttttggcagggggagaggaaagagtgtccccctttatgatgctgaactaacttgtagaatctgtgatatgtttaaacccaatgccttctgtgagaggcccagcaatgtgatagaaagaggcagtgtgggcttcaagacaattgggcttaaatttggactgtagggtaggtttcttcccttatctaggcctcagtgttaccatataaaatagaggggttgaattcaatgccttgtgagtctgtgatgctgggagcccatcaaagtcgacggttgtggtgacagttttccagacttcattcaagaggtcgctgtcagtctatcctcctctccccacatcacacatattcacaatggcctatggcaaacaaggcttagtgtataacaaagcaaggaggtgagaagcaggaggccttgccagccaaaggcctagtcaatcctcctgctgcacctgctacaaattaaaatcacagagtaattttgcagactgaggtcccagttcaggaaaatgatcaagccatgggtcatgccaaagcttgcagatctgcctaggttggtatcactgaccccccaagaaacagcaaatctggtccaccttgaccaaatctaagccttgctaatggttgaaatgagctctcccctctctctgccctacactgtctcaataacatagtactttctgaaggaagacaacgtatttcactctgccctgagcattaaataaatttcatcggctttgagatggaaagaagtggggtagggtatggagtgagggaagtgagtggaaaagagtagaagaattagatcagaggccactaaacaccacctcccccaagacccttgtttataatgtcccagaaacctagaccatcacaccaagatgggaacttgaagtttgactgctaaccaaatatctcaattagcagtaaaggacttggtgaccaaatgaagaaataacatacattgttttaatcctatctttctctcaagaaatcaaattttcttgcttctccatcccagaatctttctctcacacataagaaaaaaaagtggaattgatgctaatgaacattctgtggtcagaaacccctagagaagacacagctcatgactatttataaggattttttcctccctccaaaaaaattaccatctgctttgattcagcaaaaggaggtaaaagcaaaattgagtaagcactcattgtccacctttagaaccaaaccagaaagcaataagggtatacaacggtctgcaaggaagtgggtccattcttcgaatgtctgccaaacggaggtccagtctgtgcttgaatacctacaaggtggattgtattaccgttaggggtcagcatactgggttgttggacagctccaggggacacagcctcctgtagggctcagctctatcctctcagatctttcaagacattcgttagaatcagacaccctccccttctccaacagaaaacatactcttaatttgtgtagacttttctttagggacagggtctccccctgccacacaggctggagtgctgtggtatgggcacagctcactgaagcctcaaactcctgggcataagtgatcctcctgcttcagcctcccaagtagccaccacactcagctcattgttgacatttaaaggaagcttctccagccctctgtggctaaactcccttctcccaaccattcttctggccaggttcctggcacctcactccttcaaggaacatttgctgacctgaacaagttggcatttcaaaccgtatcttcctccttcttccaggccatcagcttcttgcataaagcagcctttgggatggtcctttgggaccccgccagctctacgcatgcaggtgtacttaacacagactaatgaatagcttttctttcttcacactccctcccccaaatacagatcacacgcctctcctgtcaggttgatatggcaaagcaaattactaaaaaatgttgacaatgagtgcttattcaattttattgctttttcctgcttttgctgaatcaaagcaggtagtaaacagtcttgcctgaccactatcaagcacagcaagaaggatgacatttccctacctgtgggcatgaaagctaaatccacaagcagaccccgggggctgcctggaggtaagtgaggactgaatgacatacaggttcaccttagaagccctgggctggcagttgttcctgctcaaattctttcttttctatcagtccttcccaccaccctcatgttaccagtaaaggaaaacagacagtacaaagcaagaggagctatcagagtcatggagtaggtcagggcacttcaagttcatagaatctttacacgaaaggattattttagagctcatctacccactcatattgcagcagaaagaattgaagctctgggggataaatgacttattcaaggtcacagtgagccaaagctgagatttccagatcctaaccagcgttaaatttctaagctgcattttagcattccacttttcctcattttgcctattaaatcctccaaggcctagttcaggttctttctggtccagaaagtgcccccagtcttctccaattctacagagatgccttccttccctgatgctacagaatgtatcatctccatcactcattggcaccaataaataaaatgccctttgacatccaagagtcatgaaactttgagctggaagggtcattggatgtcatttaactcatatttcagtttcaaacttacataggtcagctcaccaaggtagctgaagttcctttggagaaaagctcttgtctaacaatcttgatgattgttatccctctctattcagcaccataacctgcataaacttcatatttggttcagaataccagtttagcaacctacaagaatgtaggtgtctggcagaccaggattccagttccaggtctgccattgattcctggcatgactttggattacgcgtttgacctctctaaaaatacttcctcatctggcaaatgggagtaacagtagagcccactccatatatgttatgtaaattaataatacaaggcaggaagaaagctcttagcatcacattaaggattcaataactatttgctattctttgatcactttcagggagattcactttgtcaatgtcattgacttataatcagattctaaagaagaatcccaggcaaacaaactttggagatagttcacaactgaaggaaacttccatttacttaaggcaggctgaaatttgatagggagactagaaatacaaaaaggaaaggatctgcaaaaaaaaaaaaaaaaaaaaaaaagacttgcttccagtctgggcattaccaataacagaaacaaaagaggcagaatggagggagccagggttaaatatgaaggtgaccttggtgcacgcagatgggagatagtgcatgcaaaattaccttgaggtcccccactggagtttgaataaactaagaattcttctttttgtttgtccccctttaataccagggatggtttaccaccactaattctggtcccaggacccaaagtgaccagagggctttggtggacaccatcaccccctagtggtagctccacactccccactattggcagagtttggcatttaccaactttgcatgctcagctgtggcactggccatgtccgtatcccctgaactgataagctgatagtgaaagctgcccaactcgccagagacaaacgttaggcaggatgtttaaaagtctggggatgggatggggctgccttgggacactagaaagagatggccataaatgtctcatagtatcagccccaaccccacccctaccaccacccccacctcacccctcccccccccaacccccagcgggcaccaactctcatttccggccagctaggtcctcccagaactcattgtgcactctgtgtttacacacaaacagtggaagaccaacacaaataaaaatcccacgtctccctacacagctcctgctatacccagccatctggtgactacctcgctagccaaatccccgttgagagcgcctaaagctgccagcccagggcgctagggggaaaaggaggaggcaagaacccaatcccccgcatgcatccaaaaggctcagcgctgccaaggaggccagccccgtgctctccaaggggcagagggtcccaagctgccaggctcagggaccgtgcatcagaggagggggaagtctccatgtgcaggttgttgccaggagactctcaagcaacacatgggtcctgggggaatcaagacttctaattcctcgctcaggtcctcactcagcttgtcccaggctcacaggcacccatcctgtttgaaagccaaagttaaaaatggcaaagattgtcagttccaggaatcccggggcacctatacagatggttggagcaggtcctccatatcctcgaagacttgaaatgctctgtggtcctcactgccaagtcaggccatacccaaggaccgtctcatcccttcacttgaatggccgtttggggggcgggaggatttccacccctcatctctcagagtaccccggagtagagagatctaaaggatgaagggagaaggtcaggaatggaagtggtagtgaagggataccttctgtgtctctagaaagacccttccccacggggaggtggcaagagccagctgtgagcctgaggttagtccggcggcgctctaaggaacaccacctccaccctccttccctttctcggacatgggcagccccacaggtgcacgtgggaagagctactggtttgtgtgtgtctgtgtgtgtgtgcttggtgcgtcgcaccccagaagcgccgccgcggggagtccccgaggaacctgcaggacgctccgctgcctctcctcccggaacgctcggcacgctcaggttacagcctgcgagggtgggtacaggggctcgacccccgaggttcaagctcagagcgggagaaccactggcactcgctcaaatccccagaggtggtagcatgaaaggatggggagtgggtcacaaaaatacttttaacaatatcagggctaccaggagagtggagcgtagtccgctgattattctgtgggtcttttcaggcgagcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccattcctactctcatgaaaatccatctggaagggcagaacccgcaactccgaggcgagagcgagggggcggtgacggcgggtggccagtgacggtacccggagaagtgggaggctcgacctgaaactggcttaggatctgggatgctccggcccctagccagagcaccttcagtgaatggggtctccggcttccgggatggatcaagcagagctccaggtcgggactgagaggcagaggggcaggttcccactgcgggagggttggcacgcccccaggctcccgccgcgcgctctccaggacctcctcccacatgctcgtttccaaccacctgtgcgacctctgggcccctcctctaccctctgccaaccccactcggggcagccccgggcagggatccccagggcgcccccacccgtccggcatgacgcaggggctcggggttccttgggatctagcgcgtgccggcgcccagccttacccagggtgaagaagggcagctcggtgttgtccaggtcgtcctgcaccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaacc

SEQ ID NO: 268 - DNA, 261991 bp, Homo sapiens
  source 1..261991: mol_type = genomic DNA
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttgg

SEQ ID NO: 269 - DNA, 262039 bp, Homo sapiens
  source 1..262039: mol_type = genomic DNA
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 270 - DNA, 262039 bp, Homo sapiens; identical to SEQ ID NO: 269
  source 1..262039: mol_type = genomic DNA

SEQ ID NO: 271 - DNA, 262039 bp, Homo sapiens; identical to SEQ ID NO: 269
  source 1..262039: mol_type = genomic DNA

SEQ ID NO: 272 - DNA, 76420 bp, Homo sapiens
  source 1..76420: mol_type = genomic DNA
taagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 273 - DNA, 124792 bp, Homo sapiens
  source 1..124792: mol_type = genomic DNA
gaagagaaagggcagatgtaattggtccatacgcaacagttagaagactgaggctggcagagtggattacaaacacccaccactccgtgctgtccacagacaactcccttcagacagggcacaggcgggctaaaagtcaaaggatgaaaaacggcacgttacaccgacaggagtgaaaaagaaagagctggaatgcctttgttactgtcaaaacttcagagcaaagacaattacttgggtccagggtcctaatgacagatcagtccaacgagaagacacggtgatcctaaatgtgcatgcgtggagtatgtcccgttaggacaggggtgaggaacaggctgcggctgcccacacttgtaagcgccccacatttctgcacgcgtagctaacgttagagagagtctttctatacactcacatcctatgtagtaaacacagtgagcttcggctgggaaaagcggctgctccggccgaggaaatcctggtcgtgaatgaaaatgcatctctgtgggccctcacaggcccacgcagaggtgaatgaatttggctgtcttctgcatctgcatctcctggacgctcactgatctgccccagggcctggtggttgctgtcccagcttggtcctgcaagcccctctgggtggagctgctcaccccgtgctccggggctcacgcctgcagggaggcccagcctgtatcaggatcctcttcacaacctcctgaccccaccgggcggccctgcggccctccagctccaccagggcagggctaagcctctccggctggcctggcatatatgctccgagacatcacacacttggatatggcctgggctgacataagttccataagcacctgaaggctggtgcacgagggtctctggctaagccactgcacgcttaggctgtgcccttccttcctggcctatggtctcacctgctgtccctcctctccgtggtggagacacccacacaccttcgtctaagcagaccagcagttgacttggatcggaaacggcttgtgcccaagcaggcccagcaacacacgtggtccttcttcagttggttcaatccaatgctttagagaaacacgggattttagcattattaaaagatgtggatatagcaaggaatggaatacaacaacttcagactttggtgggtggaggcggaatacgtaaacctctgacagccatgaggagaccgagccctggctctcttgtgggacctgctgaccccagcagagccctgcagacaatccacagatacacggtggtcacttccatccagggagttctggcagggtttgttatgtggcaacagcaagtcaatacctcatcctagttcttcccagggcagtgctgtgcacagagaagacacaaaatatacttcgagttaatacacatttaccgagtatctgctaatttgcagatggcgtgctaaggacaagggagaggctggtgatccagatggcataattcctgccctcagggagcacagttaatcatactttgatgagttctatgaaggaaattctcagcaacacaggatgacgggtgagttaaatgctatggtgttaggacagaaagggaaataggcagtgtagaatagagaccctagagaccccaggtggagatccatgcacacgtgggaagtctgcaagtaacagaagcagcactgcagaccagtggagagacagtgaactcactggtgatactggaaaaagaaactttccacatggcataaagtaaaactgggttcctgcctaagcacgcacaccacacacacgattaggcccagctggattaaaagcgtgtgtgtgtgtgtgtgcgtgtgcacgcacacacacacacacacgcacacatacacacacactattaactttatgaccctggagtagggaaaggcttcttaagcaagtccaagacactcaacaaaggagaagattgatagattttactacacaataattaaacaccgtaaaagatactattctaaataaagagttaagacaaatggtagattgaaagaaaatatttgtaacatatatgacaaaggattaatagccttaacagatcaagaatattaattccatcagaaaaagagtaaaaatgggaagacgacatgaaaaggcaatgcacagaggaggaaggcagcaacatgttaatcagtcccccatccactcggtgcctggcacaggaggggccccgcctcccgccagcctcttcctagtgcagacatcactgctgcctaaggatgagtccatcaccatgaagacccaacgttagctccaaacagcttcatggacacagctttggagagagtgccattttaacaaaatcaaagtcctgatacaggaacatgtatttttgcagtacatcttggcagtcacagtaatggctgtctccgcatgagcatctgatgttaatgctcactctgaaccactaaaacacaaagggtgagccccgtgtgccacagccagcccccacgtaggtgagaaggctttaggatccaatcatatatgaggcccgtgtttctttctcatgcacttatgggaacagacaaaaaactatgtttagaaaagatgcattattgaagaaattttaatttaaaaaaaatcaaaagaaaaattgaacagtgcctaaatctttattttcataacctacattttttttcaaattagacagttttacactgaatgacacaaaaggaaacttaaattaccaatagtttacatgtaagcttgattccagtcttaatgaagcagaacaaaaacgaaaccctcgaggagcgaccacatgacccccgcgctgtgagctgctggcggccagcgccctcgcctcgattgtctgcagccctgtagtgggccgcgaggcacgcaagccgcaactacagctcgccagcggggcacacagacaggcatgcaccaccactacccgtcgcccggatacactgaactggttttgaagcctgaactgcagagatcctaatatagcaacgcaggacgtttacggccacccgccagtgacagccggtgatgtgatgacaggagggcctgggtgaaaatgtcaagacactcactctcagagaacgacgactccacttgaaattcatgtctggtgaaacgggaccaggtttttattcttctatttcaaaatgataagcatcatcacacgattttacaagttaaaatgccatttgtcactgctgcatctctgattctataacctgagatactgctgggggtaaaggagggtgttaacttaaaaaaaaaaaaagtatgaaagccactctcatcgctgtatgtgacacagcacagttggcatggaccgccacagcttcctattatgataactctcattttcttctgagcagaaactcttgaagtagtatcaggttttttcagacattatatagcaatctgtatttcacctttaattaaaaaggatgctataaaaatcacctccgagcaacgtttcagttcttgatgcagaagactgctgctggctaggcagtaactacagtgtattgaccggagggcagcagagccctccagtggcgactggctaatgcacgcgctgccctcctcatgcagctgttgagctcccacttcggtcgacaaagtgaaggactaagctggctctaaccacacacacacactgcgctgcaatgctcacaccttgggggaaaggacttctcattattaaaaaccaaggactcactggcggacgggcaggccttgtgttttgggaatggctgatggcgccctggcccttccgtagcgaagatgcagctcgtaggcccaggcctcgaggttgcctcccagctttctgagtattgagagtttgggtttcacagatcaattatttctgattttttttttttttttggtcagtgaactgacaactacaaaaaaaaatccccatgttctttaaaatgcatttgaaaaacactagccctgtggctatttctctgtatttgaataatggcaactgctttaaaggaaatggtcaaataggcatgttttcctctggcagggtcaatcatgcttagctgcaggtgatttaaattagattactagtcaccttcacttacgatcctgccagtttttgctctctatatactttaaaactctttcacattagatatgattagtatgcatttacatacattttaaaagagtatgaaaacatctggaggcttttaataagactttccaattcccttttgcagcaaagaggcagaatcagttcaacacaccgatgtaagagaaaaaagaaaatctcaacaaatcaaaataatattcaaaccacaacatttagtttatctacatcccgctcaacagcaacatttataatatatcaataatctgtatcagaattttctctgtagggtacctttttcatatgttctgattatttacaactgtacaagcgaagcacactccaagtgcacgtatttaatacagtattgactatttgcatttacaggattttccaacattctgaaaaaagatcaactgttgaagatctttaaggtatattacaaaaactactactagctcttgtactacagtatgcttactcagtaaaactagcgacaggagatccacgcagtaactgagtaactctgacccactcacgccaacccagggccgggctccatggactctaagctgtcttatacaaaagttaaggcaaagtcattttcaagtttaaataaaattcaagtctttaaatattggatggaaataattttttcttaaaaaaaaccctcagtcttgttaaataacattttgtggaataaagtgtatggttacatttagcaggaaatattcttattttaatgtttgctgcttagaataaagaaaaatttgaggcattttaaaacaaaataatttatatttaactttattataaacttgctaactttagtgcatccttgttcttcagaagtgcagcacttctggaagtgaatcaatgaggccctcgtcttggaggtaaaagagcaggaactttatcctccaccagccaaagagggggaaaaaccacaaacaccattctctcacgattacataactcttaaatccatgtgctgatgcagaggtacagggagatgtccacacggagctgaagatgtggactctctccaaccagagtgctggggaacacggacagaaatgtgcacagagcagggccggggccatcagctcacaggggtcaaaacaacatcatggtacaacttctggtaacatgtcagtgggcaacaaagtgtatgttttcatgtaggttctattcacaatgtgctttgaatttatattacataatagccacttgaaactggagtgagaagctggttacttgcttgcagtgcatcagaaccaaggtttctggggtggcccctgcaggttcactccgcccaggagatcaaaaaggatgcgctctctacattcttaaatgccacagtcccctaccaacggcttaggtggaagcacagctcccacatcagcactgatgccctggcgcggccagcactgcctctacgaggccacacctgcctctgccaaggccactggccctcattcatctgcggggacgttctagagatatgcacttacagaccagttacttaaaaaaaaaaaaaaaaagcagagttcccttaatttagaaaaactcactatatatagcttgcattcagagccacatggaggcttaataaaaaataccaatttgttaggataaatgctttttctatcttggaaaaaaaaatcagacttatgcatcacctccagttaagcaccaacctaaaataaggtttgtattaattaaatcctgaaaaatcgattttttttcaagagggggagaatccaactcacagaagaaaaccaacttgaggatcccacaggcctcagacactgcaagctcctaaccagcggctcgccctcgcactgagtgggagagtgtctcgtttgtggttaacacagcgctctgcgacccctcccagacgtacggttttcactgaggagacttggggggagtgctctgctctcggctgagacgcttccccatggccgagggcgagggccggccccccgccggccgcctctggtctctgggggctccaggtgtggacttgagggctgggggctcccggtatctctctgcgggctctgccagcttcttttcctccttcccacaaccaacagtgtttggcttttgttctttttggggttgcaatggggaagaaggaggctctttactcgttctctgacaaatctctgcgtagctgggctttcgcaattcctggaaacagacaatcctgggttacctgtgtgaaatggtgtctctagggacaagacaggaaatcaagttcacttaagataaaagagttttcaactgtaactaagtttccatcttcactagtgtttttaacttttaaaaagttcataaaatctaatgatttagtttcccctgcagcagaacactccctctgtgctactgtagtaatggataaaattagaaaaggcatgacgaagaagagtgctgactcaacaccatccctacccagccctatgcctgcttgggcaatgcggaagcctaggaagagtccggatgctgcccacactggctccgccagctcaggacaacagaagggtgtcccaggtgcccacggtgggcaatggaccctcacacggtactcaaccctgaaaggcaaactccaaaaacagtctttaaataaaaatgttttgcacatttcaaactacaaaggactggaaatatctaagaatgatgaagacagctaaaatcttcaagaaatgtgtaatagggttttcaggtaagtggaagcataaagactaaataacagaaaagtaaaatatttcccttaataacttttttttttttttttttgagacacagtctcactctgtcgcacaggctggagtgcagcagtgcaatctcagctcactgcaacctctgccttccgggttcaagtgattctcctgcctcagcctcctgagtagctgggactacaggtgcccaccaccaaacccagctaattttttgtattttcagtagagacagggtttcaccatgttgttcaggactgtctggatctcctgaccgcatgatctgcctacctcggcctcccaaagtgctgggattacaggcgtgagccacagcacctggcctcttttattattattattatttattattaaaattattaattttaacctataaaaaatccttttttagactcagcccaggggacagtaagggattaaactcccaaattcaaggaaaaggctcccccaagatcaaactacagaggccacaactcagagtaagagaggccacagttcacccagtagggaaaacagcagaaaggaagtcgctggggttcaggcctgctgggcccacaggggttggaggctggtggggccaccatcttgctcttcctgtctcttcatcagacacacgatgcgcgcgcacgcacgcaaacatacacacacgcgcgaaatgctgaaatgatcctaaagtctatggagaaacaggagctggggtcttgttactactcaagaaacctctattgaccaacactgaaataaaaggactacatggtggtctgagaaagaactagagtagttagtggaaaattattagcaaatattaaaggtattttgtacagaaaacacaacacagacagacgcaaataaaaacccaccaaattagatgtgattaaaaaacgagcaggtgcaggagtgcgcagcgtctgttcacaccagagcctcgcggctgtcgtgcaggaaggcaggcacgaggtacgtaccgtggcggctccgttcacctgcaccgatttacacgcggtcgcagtgagggcggaaggaagtctgtccacactgtgggtttccctctgtttctccgccaccttgggatcactgtaaaaatgccacccgatatttgaatctcatgcaacatcacaggccattcaagtcagtcaacaccaaggcgctggaagaacaccaatactcactcgggtaaatgagctggggagggggatcgctcgtacgttgctgatacagcacaagaagccggcaccgagggctctctggagaccactacaggaagggtgttcacgcttgcgtctgcactgagggtctgaaacagggtcaagagtgttcatcagagtcctgccggcactaagcggagctggtaccagtgcccgttcaccccacccgtgaacagccttgggagagcagcacaaggacataggggaagagggtcttctccagcaaaaatgtcacagagcccaggactatcctctgccccacagatcgcccacccttctctttctcggcaaatgccccactgttcttacatcacaggcccttatctcctctcccgcaatgatgatctacaagcttatttcttaactgaacaggcatcaaacacatctcacccacctggcactttgggcccagcacggcacggcacaacaccacatgcatatctgctgagtgtcgaatcctaacacagtccaacacaactcattcacaccgctgagaaaaaacaatcggcgcctccacacccatataaatgtgagctcccagccctccctgaattcacaaccccaggaagcaggtgtgcgaatgcccccatctcaacaggtgaggaaactgaggcccaatacctctaagttaatttgcccaaggccaggaagcaaaggacggagtgaaacttactccctccttactccagccagcgacccctgtgcaggggctatttcatgtgtgcttgatcttatacatatggcatgtgatgatacacttgtcatgcaacttaaaaaaggcaggagggcaggtgctctttacacttctgcccttagatgaaggctgacgacagacctagagcccttccagctggagaaccagaatccgctgcaattcctgcgctcgaccagcaggaatccagcttggtggaaacaagagggcaaaggactccttttgtaaaagctcattttaaattcagggtaggggccgggcacggtggctcacgcctataatccccgcattttgggaggctgaggtggacgaatcacctgaggtcaggggtttgaggccagcctggccaacatggtgaaaccccatctctactaataatacaaaaattagccgggtgtggtggtgcatgcctgtagtcccagctactcggtaggccgaggcaggagaatcactggaacccaggaggcggaggttgcagggagccaaggtcgtgccactgcattccagcctgggtgacagagcaagactctatcttaaataaacaaattaactaattaattcaggatatgtgcagtcccaatgcaaatgaaatgcagatccacaactgcaggtcatgaagcaagtcagagtgaccatcacgagctccatgtcaacaggggaagggctgaaccccatcatttctggagcctccaccccactttgaaacccaagggccacgctgttgactcaagaagctcccaagaagcagcaatggagcccactacacctgggtggtggcataaggctcagggtcaggcttttcaaagaagcaattctttcttcaagagaaaccttacacaagactcaaactgggcacagcaggagctgctgtttctgaagcagggttggagacctgcctcttctcctccactcaataccaacgggagtaggctacagttggaaaactagaattcatgatctttaaactgcatttcttctcaaggcactaataccttagaaatgacggtgtggaaatttaaggctaatgtgacaatcctggaatgtactcaatctccaaacaggagcatgaccatctaccaatatgaaaaggactagacacgtcacctggctttcattgtaaagatactgcatcaaaatccaccttaaattctgccctaggaagtgaggaatggttctatctactgcggggccttccctaaagcccagggtggaagagacactgactctgcagacctgggtggggtagcaagcagcacggtcatgtggcgtggaacagacacgtggtaactctggggcacagctggggaaagggcccctggcacaggggacaccggcaacctggagtgctcagcaggttcttcctgggctcttcctatgcacagtaggtaactgggcagaaaacttcctctgtacttcccagagccttcaacgccaggtgtggcagccggccaagtcccacttccacctcctaagcacattagaggccagagtgctgggctgagtgtcctctgtcatctgcagctcgggacgactcctgggatgatattcactgcagtggaggcggcacctcgtggggcagcccagacctcaccagaagctaccgacactacagtgaggttctcccaggcttcttgctccttgtctcatgtagattactacacattttaatcatttccaatacaattcagatgtttccatttcattctgttgttttataaaataaaggcaggtctgaactacaacaatgacaatgcaatctaagtttctgggtgagagaaagggtgtgtacggcacatcatggcacacgtttctacctctgacttcatcagacagcaatgttaaggagaaggcccagccctgggttcaaggctggccttactccaaatctgtgtgacctctgcaatcacgtggcctccaagcctctcttgagtattaaaaacaaacatgtataaagagctcagcaaagcgcctgacacggaacccgtacctagacactgttggcaactattagacatgcaatatatcccttaccctttctttggatggtcctattatcaagctagatagcctgttttcaaacaagtcctctgtcttcaaattgccggcagctccaggtaatggagggaagctggacagccccagctcgaagcttggcgacggaggctttggtggcgttggagactgtgtctggctgctctgcaacagaatgacaccccagggtcacggtatggagagagaaggccaagcagcttctcgtttccacacctgtctggaaaatatctgtagaaacaagcagatcattcaacccagacaagggcttcctcactcaattgaaggttctcccaagcaacttcaaccatctagagcagagctgtaaaactgaaatctcaaggatgctgctgcccaagagatgtgtcacaaaggacacagtgaggctaaggtgacatccaaagagctatccacccatggctgccagcactcacgaacagcaggggcagctgaaggcaagggagacactctggagtgactccagcccaccagatggaaagcagggcagcctgagtctagacattaaactttctcactttcagacaagtgttgtgttactacagcatagtttttaatgtgagtcacaagataattgtaaaaaacaaaatatgacactctctccacaacctgtgtaagaaattttacacacgtgcatcaaaaaagtggtttaacaaaagggaagggggctcgaattctctgaaaataaacttaatgaaagtttatatttttaaataattaaaaacacaggatttgacaacaaattctaatcagattctttgacttccaagaaagcaaactcagtataataagaagtgagtgtactttgtaagcccaaatctcagaagaaaggcagtaataccttttattggaaaatgatctatcaacccgctttaacaagctggcagtcattttgcgagtacgcagttcctcggctgaaggacacatggcacagaaaggggaaatgagtttgcatttagtttagaaatgaatttatattaactaaagaatacaactatttttagctgaaacaatgagctactctgaccaggaagcaaagatctcatgggatccacctaactggaaagtgccaatgtttctccaaagtttatacacaggaaggtgaatccctgcatcagtagattctagagaaaatatgtcagaagtgaaagcaggtcaaaggatgaaaatgaattcaggctgacacaaaccccagtccagtctgtgttgggcattccgcttgcttctctgctccacgcgacaggtgcctaattttagcttagcttttcccagttaggtgtccttggcagtaagcttgttacctactgagcagctggctgttgtatgctctctgtaacctagtattgtgaatatgatgctcaaaatgatcctgcaaagctctaagttacacatggccactatgatggcaaagcggttttaaacatctgcacgtttctgaggtgaacacagcttttcagaagataagcattattagagagacagccttccccaaaaatgtatttaaatctcaacttgtagaagcaaaagaggcaggcaacaactgcccagatgtgggagttacaaaatgacatcacccacagatgggacttgacttggaaggcagtgttaaaatcctctaggatctgagcacctctgggtgaggtctgagtactgctcaggtcccatgggcgtggttaggcccgaggctcacacacttttacagaaaaagcgtctggacctttctgaggtcctgagagcacgtacataagacgatgggcgtatgctctgtaatcaatacaacactgggccacaagccgaagcttcaaagcaggtcacagtcatgaacacatgcatcaggaatgcaaggcaaaacagaacggaagagaaatggctgtgggaaaacatcacggcaggcacaacagtgccctgtgtttagatgcttgacttgttagtccaaatggtcacaggaattcactaattccaattgcaattaactggtaaaaactgccttaccaactagttaaacaaaaactagactaagccgacctcatgaaaggcacaatttctgagttctaaacagagattgtatcttttgtgatgagaaagcacctgtgtgatggcttgaggggctggaccaggatttgtccaggtctcctccagcattccttgtatggaattccacatctgcaagcccatggaggcatccctcccatcttcgtgggtactgctaactgccaccttgctgtcccactactggttcgtgggtactgctaactgccaccgtgccatccctcccatcttcgtgggtactgctaacactgccaccgtaccgtcccaccactggttcatgggtactgctaactgccaccgtgccatccctcccatctttgtgggtactgctaactgccaccgtgccatcccaccactggctgtggagaagtccatgccatcctccactaaagaccagcacaaacattttccacaggagaaactctgattaatcaacccaagcaaaaatcaccatgtctcatgtacttaccgccacaaaaacctatcacttatgtttgggtctgtcctgccagtaagttatagcagaaggagataatgctttctacacagtgggagagtattcgaaagttttgaaggaaaaacaccgacaaacaaattgctccgtggaagatgcttactctgctcattgaaatgaatggctccagtcatttcagactctccggtacagctgccacacagaagagctcacgtgcacacccgtgtgtaggctgcagtgcatgcgacagcaagttcctggccatgcctgtgccacagcacaacacgcctgtgcactgtggagtcctgtgcagcacatcgctatttccaaaacctctacagttgcttcctcctaggccagccagggtgtcagttattacttagtggatttcacgttacaagtcttttgaaatgctcattcttgtgccttaaccttaatccatttaattaaatctcaggtttggtataaattagatttaaatgtcttgtgaagaggtatatgctttatgtactcactgtaaacttctcctcccttttcttccggtagccaaaggaattcttcctagaggagtggaaagtgaaagactgttatttttttcccacttggagaatttattattgagcacgtttgcactcacataatcaaagtacacatcaattcagtctttatcactttgaaacctttcaaagatgactttcaattctaaaatcccaacttcaggaagcgtaagcagaacaacacaaagttgacagcaagggactaacgtggaagtccaggcaagtgataaagaacagaagaaaacactgactgaaaccaactccctggtgcctccttgggatgtctgttaagacatgagtactgaacatccactgggtggaaatgacaagacacataaaatctgagactgagctccatcaatgagttgtttaaaatggtggtgagaattttcccggcgcagatttgctttacatcagatttaaaagaccccaaataccgcgtcccatcccttcctctgccctctcagcttcctccactactgcctcaatggctgaccccttcccacgaaaaccacacaaggacctctgtgccccaaagacttcctgccctcgcctcccagcctcaggaaccacattctggacctccccatgcaggcagcaaggccacgccacacacgcagttgataaccacaggacagacactgattaagtggtgacttcacgtggagacctaggactctaggatggccaagacattcccatttccctggacaggttatgtggtctaacaagtcacatgacacacattcatctcaatggataatttaatggaatgcaaagactcccccaagggccttgtattacataacctggaaaggagttaagaaatagtcttgactaattccttcatttacagaaaaccaaaaactagtcttgcctaagatggcctaacagtggaaaactctgtggaaccttgggccaaaccctctagggcaaggacggcacaaacctttaggattctggagcaaatccctattatctcctacagaaaactttctggaaatagctcctggctttctactggtgccttgcggagactgcaggccagactatgggacatggatgagtactgagccacaggtggggcatgagtcctgacaacccaacctcctgtaggaacagggggcttggtgctccttgtcctggatccatgcctgtggcctcacagggagagagggtcctgggcctgcattatggacagccaccccagtacacacctggctcagcaccactccctaatagggggtgctcccaaaacccagggagctgaactcctactccgctgcgccaggattcagaagtagtggaaaggtggggctacaatgacccatgagcagagctagggatgcaaccagatgagagtcttcagtgggacaggactcaactggccctggggacctgggaggggtgtgagacggatggtgtcagcacctgcttgcccagaggcattgccctgagcgctggacagagggacagcagccacatgggcagaggacatcccgcagggctcggcacagggcatccctccgccaagggcagcctgctcgtcactaccggctgggacgcaggggcacccatcccttggaacacagcggtgtccaggacacagacctgcctgccatggggtcctatcccagtcaccatcagtgggcccagccaacactcccccacaccctcactgggctccacgtaacccgtgtcagacccagaagcccacctgcagccgtagaacactgtcagctgtcagtgcccatcatgcagagagcaggttggctgagccaaggctcagtgacagggccatggtgggttacagctcacaaggggtagcaagggacccagggtggtcccagcaccatagaggaaacatcactgtgacacccgcgactctgaatgcagtggtgtgaaggcctgagaccctgaagaggtgtgcttcccccagctgatcctaacagtagctccaccaaggcagccacctggcgcctggggctcctcatgccattcaacccagctgggccgtgccctgccatggccgccatgcaagggtagggacatgtgtctggactctggtaaggggttctccaggacatcttagcactttggtccaatagagaaagttaatggaaacaaaacaaaccctcccaaaaaggggaggtggaggcatggctgctgtggatcaggttctcagggcaagcaaggcctggcacacctccctgcaaaacagcacaagctctttctcaagacagagggaaggaggaggttacgaaggtcagctctggcttcagaacccatcgcagaaacaggctgcaggagttgcatgcgctttccctgcccaccacttcctaaaccactccctaaaccactggtgcgtgcttcctaaaccactccctgcccaccgtgcccatgctggtgtgcgcttcctaaaccactccctgccgcagtgctcaggtctcaggtgggaggacagttgtcctcccttggtggggagagagagggtctccattggtgcaagatctgcatctgtcaggcaaaagcataaacttgttacagttgcatttggaagttcaagtattgttgaagggtatcctgggtagaccacattcgtcagcaagctttggactctcagcttcaaagccacctgtatacattttgtgaggtagctggaattcaacaagccccactttcatttgccaggaaactccttgtgacgctcgtatgaacaaggcacactgaagagcacaggaggctgaggccggggggccttgtccatctagtctgcctccttccacaccgtgcccacaattgatgcccctcagagggagccacatggccttgatgagtagggctctgtcccaagtctgagccccagctctgcaaccctcctccctccaagcgtctgggtcttaagaaccccaaactgagacccagggctagcaactgctccctgaagtcactgactctccatgacacggtgggccccttttggctttgcatctccaaggcctgttgagccaacctgatgccatgtttcctgtgagacacaggccagtgccagctctcccagaccatggtgccttccaatgccactgcacaatccctgcaggaactcctatgtgctcattgaatcattatgggcaggaatgagatgcttctgatgcctcttcatgttgaattctcactgcacagagggtgtgcactgtggcaggcaggaagaggagcttgcacgtcagggatggtgctgtacacattgtatatagaacaccctgaaaaagctcaggtatttgagtcacttgtttgtcacttatgagaggaaaatcctgacggtccttaccaaggcaaggactgagaagatcaactggccttatcaacaatgggcaggtgcggtggctcatgcctgtaatcccaccactatggaaggctgaggcaggaggatggctctaggccaggagttcaagaccagcctgggcaacacagcgagatcctgtctctacaaaatatttaaaaactagccaggcatggtggtgtgcatttgaagtcctagcttctcagcatgctgaggcaataggattgcttgaacccagaagttcaaggctgtagtgagccatgatcatgccaacgtaccccagcctgggcaacggagtgagaccctgtcttaaaaacaaacaaacaaacaaacaaacaaacaaaaacctactacaggattgatgccaaaaaaatgttaaacaaaaccaaaaatggtgggcaggaagcacagctaagacccgtcctggctagtctcaaccctccaatgagatgagactgcaatgctgatctgcctggttacccgctccaggctccacctgcagtgcctggtgcacacccagctggagggcgccaggccagcagccatggggcagagcctggacaccgcccttgcagaggggcctggtgagccaggggtgctgccaagaggagactgcaggcacatgggatggagtctatggctattgagctccagtgtttctacaaataatgatctaaaacaactacagttctcactgaaccatttcatattccaaaaaagatgaagccatttaagtcttagcaattatataaaacccttatgtttatagccttcagttagattttctgtgacatatttaaagacaattacaaaacatatctaaattaaataatttttaaaatattagtttatgatgttacacagtaactgctcaacaactcaccttcccctccctaaaccaggagaggattcgagactgcctggctccacacgcccaggcccagcctctctcttggcatatgctgaagggttttgaatccgtgttctagtttgacctgcttgccttgtttgtggactccggacaccattaattaatcgatctgcagtgaagttaaatattgaaggactttctaataacccaggtcccctctctgcactaggaatcgcatgccgcagatgagatttactaggattcctgtaaataaaaatggttttatgtgttgagttataaaatgatcaaggcattacataacatgcatactgacatggaatagctaagctgaaatctgctctctgtttaataaagtataaaaataggatttggaatggttaactcctaacatataggataatgcaaatctattaacaatgtgccacaattctgcttagctgtttttcagtccaggcccaaattaaaatcaggcacacctgatgtgtacaagttgccccaaagcctcctctcagagaatctgaggcgggcacccatgccagattgtagtgcttagtctttacagaatgcagctgtgtgcttcaggtggctctgtctgcgaggagcaggactagtgatcaaagctctctcatcccaactccggaagggcagtagcgtaaagaccaaaactgctaagaccgccccggaacttgcctgcttcgaggaggatactgtctgagagaagtcagaggagacgccgcaggcttgaacgctggagacgtaaacccatttataaatccagtatttggaaatggagttacctagattcatttgaaaacagacaagtaaataaaccataaaacagacttcaatttcattaataccaacaaatctgtggaaactgagggcatttcttgatgttgtcagagtcatgacccatgctgagacatgtattttacaattttatcaccaatgggtgctgtttagaagtaggctggagcttttgtgcatcctttcagccaatccttacaacaatccagcgaggagaactgacacatgcggaagcaggcactgagaggaaagacgtggtcaagagcgcatgggctccaacaagtgttgtaacctttagcatgtcagtctgatacgacctccatcactggcaggaagtcaacagttcttgattcctgatggctttaatacaactcatcaacattctcaatcttaggagcacctgcacacccactgctgctcactcggcttcatccaaccacagcctgacagggcctttacctttaccccgacacaagtcctgctctgcagatcagggtattttcagatcatcattattccccaagtcacaaggtaagtatggcatgcaaatatactaacataagattcagaagaaattagaaagggtcacagaacccctaaaagatcttaagtagttaaaaatattgagcatagaattttaagtatcggccaactatttttaaaatctagacacatacaaaaataagataaaacttattgttaaaacagttcctttaaaaacaaacaaacaaacaaaactcaagaccattcattctaattctctggcttctggacccatggtttccaatacgttctgcatcactgatatctcgctccttatgctcctgacacagggcacttagttcctgagggccttccagtccacaccctcaatgtcactaaagtgacagagatacgcatagagccctccttgtttggaggaagagagaaaggaaaggaaaaaagcaagtaattctccttaattagagctaactggaagatataacagaaaaagaatattatagcttaggactaaaataaaatcatacaaaagggaagttagaatcttcaatttgctacttgagaaactcttcactctgtaagaatcggactttttaaaatacatcacacatggccgggcgcagtggctcatgcctataaccccagcactttgggaggccaagggggggcggatcaaaaggtcaggagatcaagaccatcctggctaacatggtgaaaccccgtctctactaaaaatacaaaaaaattatccgggcgtagtggcgggcgcctgtagtcccagctactcaagaggctgaggcaggagaatggcgtgaacccgggaggcggagcttgcagtgagccaagatccggccactgcactccagcctgggcgacagagagagactctgtctcaaagaaaaagaaaatacatcacacttgaagagccatgaatgcagacctggatctgaggctgtaaatcatgggcagagcaatgaggactaatcatttccagcaagtcattttacagacagagccctgatattccagtaattttgctcaagataaaaaataaaattggtcatatataaaaaataaagttgattattaatgcgttcctattattacttgttggggattaataggcacaatctcttcagctgcagaacaaaggacgcacatgttttagcacaagtaaaaggctgcgatggagagccccagtatcacagactcagagcaggaccagctgtctggcacacaccgcaacctgaacatacaacataagtcaaggccataagctgacccagaaccccaaggatccccgagagggtcaaccatgattaaagaaacggaagaagcaactgctgcaggaagaactgaaaggactagcatggcaagccacgtgcagcgatgattcttcaacacccagagcctacggactcaagtctctctgaggttctctcatgatatgcttttgggaaaacgaagtattcagctatgggtacacttttatagaatgtgctacttcaaaaagccagaaacttttcttaccatcaggacttactcaaaagagacagaagtaactttaccaaaggttcttacactgcggtggttccagactcagggggaattggggtcctctgaaaatctctccctgtccccacctgcccttcacacggccttaggagctattttctaaatggagtatggtttcatttctccgcttagaaacctcagacaccttcccacaagcactaggccaaagcccacatgcctcaggacagctaagcacctgcgcagttaggcctggaaactgccagctcgttccccaactccctgccacccggtgtacgcttcagctcagacacccatgaatctacgaccatcttctgttcatgaaacttctctttgattccttctgaaaaactcatacttaacctgaaaagctcaacctagatgacaacacaatccctgataagacctgtcagtgttctggcattctgtacacgtgtctccttggcatgtttgacttttccagcctgagttgtttcatggacccgtatctttactttccgtgtatacaggcacttgttttctcaagttctctctgctctgcacctaccctccttttctgcctgtcagcggtgacatccctgcacatcagggtgcctggctcccagccatccgaccctgaggaccactcagtctttcccttagtccacagcgaaaccctggacatgaactcttctcaaagttactaactcaatttctgctttctgaccataaccttctatgtatgctacccttcaatctctccaattccaactaacctgcattgctacctcatgcaaacctctaggccatgaacccatcttcacttctcaactagacttcagcttcaaggacatgctcatccgtgtattgctgactctcgtgcatccaatgccaccaaactcatgctaattcccacccagaatgcacttgatctttcaagcatctatagcagcacacaaagagacaatgtctagatccagtacagacttatgaattccaaccataggccttaacaaaggccaaaatccataaaaattaatcctgtcgaccaactctaatgctggtgagaagtgagtaaaataaggctggtaaaacagcaggccttctccttggccttgctgtcagaagcctattaaacacctcttcctcctcagttaatcccccttgcattgtactctgtgtaggggacgccaggtacactacagcacttatcgccctctgcgtcttgctaagagctgcatgacaagaggggagacgggctgtgcaaggattgtgctcacagcaatccaaagttctttatgcataagctctgttctcagctacatttaaaatcccccacataacttgaaggtctgttttagtatgtcagactgcacacatatctggcttcctattagatgaggattttaatccttcaaattatctagcatagtgtctacaacataaattcctagtaaagaaatgacgtaccaagggtgggtcaagatagctgtgcgttgctgaccacgtctggggagtgatcaggctgtacagggggaactgctgctgggggctgtacatgggagggaagtagaacgacgtcgcgtagcgctgctgggcatacaggctcacgtccaggggtctaaatccattctttggcaaaaatgtgtttatagctattgcctttgcttttatccgtgcctgtttgaaaatatgtaagtttctattagaatacttaagaacatcaatttgcaaataaacaaagtataaccaatggtcttgcttaccttaattggttttccttgaaaagttttgacttcttctcgaaggtatttgtaagcctaagggcaaaattaagtacaaaattccattcgattaaccttatgaataagaggcaccaatagttcactcaatagctcaaatagggaaatatataattaaattatggtgaacagaacctagaataatgattcttgacactccctgggtcacagatcccttaaaataacctcataagagctatggaacgtgtaccccaaattctcacaaacaagatttgtacacaattttgtaagtattaacagatgccatagaagtctcccaaagaccactggctaagaaccttgacctggtggaaaatgatgaatactgagttcctagtattcatcccaatttcagattaggagaatgcagttcaggaaataccagacaggaaggaaaaggattaggatcataacatccaaaagtcattcttgatatatctccttgttcttctccatgttaattctacattaaacccctataaaactgtgaaggccctgcacctgattcaatatcatccgaccacattcgccacacgggctggcagagctcacactccactccacaaaaatggttactctatcttccgttccccttttccccctccatccaattaaaacccatctttcaggtttctgtgttttcttttctgaaccccacatactgtttataccatttaacactttataatatgtgcgttagtttcctcacaaataagatgcttcccttaaaagcaggaaaactactaactcctcacgcctccttacagagcttacttctcaataccattaaaagcatcttccaaaatacaatgaagtctgctgggagatgaagattaggttcaaatttccccccaaacactttgcaaatagtaaaacttctctgcccagatagaagaacaaaactgattttcctaggttgcttagcttgttgtccttagaaagtaaaatcacatgctttttatattgctataaaaattgtccatacaaatacactcaaatatttaagtttctacaacttgatttcctctgcagattatattcaaacttaccatcacaagtaatctcaatgcccaagtttagtcccaacatgcactaatagtaaaaactggtaaactatgcaattcatagggtgatggtggaaagaacttacctgttgtgcatcagcttctgtttcaaatgtaataaaccaattatcattatatgcaaattcacagtttataaattttggtaaattatctcctttaaatagtgcttctacttcctacaggaaatagagatgttagaaattaattctcaacaatgtcagtttttgtcctcaccaaaaatttttttaacaaatgcattctcttaaggaactatccttaaacaaacgtaccatgatgcctagtaaatctctcttccaaaaaggatgagggttcagcagggcttccagaatcagaatcacaatgccatagagaaaagcagtcacacaacttacagcttcccctactctcaagataccattaagctagattaatgtgaaaactatcatatcatgttctgggctgataactgcacaactttttttttttttttttttttaaaggcaatttaagaaaaaaaatttgcttggacttttgcttctggccatgatggactagatttactctcccagatgactcaattaaaaaaccaaagacaaaatacatgaagaacagtttcaggccctgaaccccagcgtgaacacgagtgtgatccctgagagggacatgaacaggggagttggccttcagtgcctgggccgcagagccggcagggtaagcctgcagatggccttccccacatcttcagcctgggaaacaaccgcctgagggatgagagggaacaagcccagggaaggctcaccaagagaggaatggtttgttttcccaccggccacagtggaaaactctcctaaacacacaggatagcagggacagtgctcagaagggcactgcttccgcagtggggaaaatgagccctagagaaaaggctgctctgattccacctagaaagttggttccaggtaacttcactgcatttcaaaacaaagctcaagaatatttattagaatacaaaaatattcagtaaagtaaaatttaaaactccgagcatctcctcaaaaatcacaaagcatgcaaagaaatagaaaatatgacctataatgcaaaagattagacctagaaatgacagatacgatagacttaatacacataacacatttactgcatatatattccatatcccataaaaggtaaagactgagcatattaaatatatatggaagattgtttttattttttatttttttttatttatttatttttgagacggagtctcgctctttcgcccaggccagagttcagtggcgctatctcggctcactgcaagctctgcctcccgggttcacgccattctcctgcctcagcctcccaagtagctgggactacaggcacccgccaccgcgcccggctaattttttgtatttttagtagagatggggtttcactgtgttagccaggatggtctcgatctcctgacctcgtgatccgcccgcctcagcctcccaaagtgctgggattacaggcatgagccactgcgcccggccagattttttttaaaagaccaaaatcaaactttactggagatgaaaaatacaatgtctgaaattaaaactacactaaataagattaacagctgactagacactttctgaagaaaaggacaaaaggcagaggaaaacatttaacaaaataatggctcgataaatttcaggtacgagaagtttgaaaactacaccaaagcatattgcaatcaacttgcttaaaaccagtagtaaaatcttcacagcagccagagaaagacttattacatacagaaggatggtgataaaaaccacagaaaacgtataccagaagagagagtatctttaaaacacagaaagggaggaaaaaaccccctcaatccagaaatctatatgcagcaaaaatacctttcataaataaaggtgaaataagattttcccaaacatactaaagctgaaaaaaattcatcatcggcagacctgtacaagacatgctaaaggaatgtccaggcagaaggaaagtccagattgacataaaggaatgagaaggactgtaaatggcaaatactgaataaatataaaacatgtttttcttatttttaatctctttttaaaagtgacttgtttaaagcaaacgtaacaacgatgtattgtgaggcttatgactgtgtagaattagaatgtgtgacaacagcacaggctagaagtggagaatgggagagcatggctgtaaatgggagagcatggctgtaaggtaaagaggcatggtgctctgtgaattacacggactctagtaaagttagagggtcagctaaaaaccctaaagaaagggggtccaatattttggcttccctgggacacaatggaagtagaagaattgtcttgggccacacataaaatacactaacactaacgatagctgatgagctttaaaaaaaaaaaaaaaaaaaaaaaaaaaaaaaaaaacctcaaaatgtttgaagaaagtttacgcatttgtgttgagctgcatacaaagccgtcctgggcggcatgccgcccacgggctgaagaagcatgccctaaagcaccactaaaaaacagaaacacagagttatacctaatatgccaaaaaaggagataaaaatacacatttaatcccaaacaaaaggaggggaaagggaaagaaaataaagaagagacaaaacagaaaacaaacagcaagatgataaatttaaatttaatcacatcattacatcattaacctcttaaatgtagatgggctacactcccaattaaaagacagaaattgggcccggtgcggtggctcacgcctgtaatcccagcactttgggaggccgaggaggacggatcacgaggtcaaaagatcaagaccatcctggccaacattgtgaaactctgtctctactaaaagtacaaaattagcttggcatggtggcgcatgcctgtagtcctagctactcgggaggctgaggaaggagaaccacttgaacccgggaggcagaggttgcagtgagctgagatcacaccactgcactccagcctggcaacagagcaagatgccacctcaaaaaaaaaaaaaaaaaagacagaaattttcagattggataagaaaagcaagacccaattacacactgctcacaagaaatccactttaaatatgaaaacacaaatgggttggttaaaagaggatagaaaagacataccatactaatgtcaatcaaggaacgtgagagtggctatattcattccaaattccagaggaaaaacagcaacaaggaaaaacagggccattccataaaaaattactagccaggtacacctcaaaaagtacaaaaggaatttgacaaccaaatgaactacaaaaacggtttccagggattctaatgccctatgttgttgtcccatcactggtaaatgcttactggttaaaagataaaacacatcaacgcaaagtcatacttgactaacggtaaattaggattatgacttttaaagtcaaacaataatactttaaggccactagactatcagtctactagtggcaagaatggttgactcctctgcctctgggaaaatcctatttttaagaaaatcagaatcagtatttaaaatgtactaatcactgacaagtacctagtgacatttaaagaataattttctggaaactcctagcctacatttctaagacccagtagaagggctctataataattatacagagtccttgggaacttatgttcttacgtggattgttttaggctacttattttccttcctttttttccccaacttttaatttatcaaagagtttcctttaaaccttctctcttaagactttcattgctcaagttttacaaaagacataaggtcagcagttttgaataatataaatactccaaaatcaatgtctactgctaaatgcagaaaattctccttggttaaagttttacaaacatttcaagtcttaaaaattaggatctatgttttaaatattactttgagttaatacagatgtccaaattaatcataagaaatatgctggtcctcggccgggcgcggtggctcacacctgtaatcccagcactttgggaggccgtaatcccagctactcgggaggctgaggcaggagaagcactcgaacctgggaggtggaggttgcagtgagccgagatcgtgccactgcatgccagcctgggtgacagagcaagactccgtctcaaaaaaaaaaaaaaagcaagcaagaaatatgctggtccttcatattcagacccttaataaaaataggaggaaaaaactataatcctaagttgtttttctccacatactacaatatagaactagtaaagacaggctaagtggaacagaaggtaaaacttgctagaataagaccatacttctatgagagtaatagaatttcttacgctaggcagagagctttgttggaatcctgccctttctcacatgctagggttgttttccttaagaaactctcacacacactaacccactcggactgaaaagcctgaaccgcaacgtccatctcctctgcagagaaggtgtgtggaaagaggtagcatgaacgacgaggctgaaatcatgtgagagatgagaccaacaacaaacccaggcttcctgtgttctgcgagtccccaaagcaggcagattccgttttctgaggtaggataaactaagttgccagcaccttctacaaagactttacctcatgatctcaaggtgtgaccatcagtgtgtttactacacaaagcaactcagtttaggcatctggacaaacagtagattttatagcaacacataacagtaaatggcttttcattacttttaagctatcagatactgtggttccctaaaattactgcccaagtcgggtggattatgaggtcaggagttccagaccagcctggccaagatggtgaaaccccgtctctactaaacatagaaaaattagctgggcgcagcgacaggcgcctgtaatcccagctactcgggaggctgaggcaggagaattgcttgagcctgggagatggagtttgcagtgagccgaggttgcgccactgcactccagcctgggcaacagagcaagactccatctcaaaaaaaaaaaaaaaattactccccaagttaccagttctctaagagtggccgtgctggcttggaccaggctgcactggtggctcagggagttattcacgatgcccctttgtcatagaaatacttgttttgaaaagttttttttatcacaaaagtgctctttttcattatttatgggtttactaatcttatttttaaataaatatttaaatgtgttatttttaatttctaaatatagaaatgcataaaccttcactatcttattataaggagtcctgagatcaaaaggtttggttatcattccctcctactctgtaactcactgtgtgtaaatcctgggaaaacagtgttaatgtaagtactcagtctaaaaaacacacagcccaaaaaaacacaaaagtaaaataaaatcaaaaccaacaaagacctttgggaaaatgtccaagtaaccttcagaggagaaattacttacttccacgggggtagattcagatatttcacgcaatattactatgcagcgattttgatttggccttactttttctcccttttcatccacttggactaaaggtaaagctacaaagagaagaaaaatcaatggtgaaacaaaaatattaaaatatgatatgccagtggaatgtgttacattatattactatattactaaataagctaaagaaacctgcaaatgggcaaagtaaaccaatctcacgttagatttttcaaagctcaggaatatggacatttaaaatcctgcaggagccataatgtatgtaacactatgaaacaaaggttctaaacagctcaagcactaagagcagatgaaaatacagggttaacggctttctcctttccaccagtacctaaagtgagataatcttgtttcataacttgtttctgtgtgcccttccctggctccctgatgatcatccctcacctaacggtcgtgcactgtttacattaggatgctcatgtgactgcagtaataggcctaatttagatttcgccagtttttacataaattgggttttggcatcacatctaagaaattacgcaatgcgcagattcgagtcacagcaagtaatgatcacaattagggctcagaggtgcccactgtcacaaagacacaaatcaccagcatcaggatgaaagtggcaacatcattacaggttctatcaacaggaaaaagataacaacggaatattatgaaaaagttcacactaatacattacatgaaacagaaacattccttaaaagacataaaccaccaaagctcaccctacaagaaaggtaactggtgcatgactgtaacttagtttttatatcttaatctgacaaaagatcatcaaagactcatatgctgaaaactgcaaaacactgccaaaagaacattttaaagacctacataaagacatattctgtgcttgtgggttgtaaaacttaacactggtagaatgcgtgaattcttctcgagtgaatttatacaatcaatgcaatcccaataaaaacaccaacaggactttttgaaaaattgtaatgatgattctaaaattcatataaaaatgcaaaacatttacaagggccacagcaaagctggaggttctgaacctactttaagactcactataacgttacagtgattaagacactgtagtgttagcatccaatcagacaagtaatcaagggaataaaacacacgttccagagaccaacacccacgtgcacgggcagtcaatacgacaaggccccagacacgtggggtgctgcaacagatgcacacaggatccataccccacaccatgtacaaacatcagcacaaaatagatgacagactcgaatgttcaaatgtaaaacataaaactaataaaaggaaaactatcataaccttggaccaagcaaagatttcttaggtacaacaccaaaagcaagatctgtaacacgaaaaaaatttacaaattggactatataaaaaatgtctacttctgcttctcaaaagacactggtagaacaaaaaaaaaaacagctgtacacttagagagcatatttgtaaatcacgtgtaatacatatttaagtgtacacacatacatcattgacaatgtgaccgtggagcaaaggagcatcttttcaacaagtgctgctaaaccactcgacatccacatgcagaaaattaatctaggtgcagacctggcaccaccattcataaaaattaaccccaaatggatcatggacctaagtgtaaaatgcaaaaccttaagtcctagaaaacataggagaaaatctagaaggccttgggtctgacaataacttcttagataccacactaaaggcatgatccatgaaaaaatttcattaagatttaaaacttctgcttcgtgaaaggcaacgtcaacaggatgagaagccattgactgatggaaaatagttgcaaaagacacatctgataaaggactgttaacatcaaaatgcacaaaaaactttaaaaatcaacaataagaaaatgaacaagattaaaaaatgggcagaagacctggacagacacttcacaaaagatttacagagggcgaatctacatatggaaaaacgcttcacatcatatgtcatagggaatgcaaattaagacatcaatgagatgtcactgcatacctgtcagcacagcaaaaatcacaaacaatgacaccaccaaatgctgccgaggatgtggagcaagaggaactcccattcactgccgatgggaatgcaaagtggtacatccactttgggagacactttggtggcttcttacaaaacaaataatattcttagcatatgatctggcaattgtgctccttggtatttatccaaaggagctaaaaaattatgtccacacaaaatctgcatacagatgtttatagcaactttactcataactgccaaaacttggaagtaatcaagatgcacttcagtgggtagatggataagcaaactgtgggacatccagacaatgaactattattccacactaaaaagaaatgatctatcaagccacgaaaagacatggaggaaccttcaacatatattgctaagtgaaagaagccaatctgaagaggctacatcctataggatccaactctaggacattctgcaaaaggcaaaactacagaggcagtaaaaagatcagtggcttccagtgactgggggaggcagggatgcacgggtggaactcagaggacgtttaggtcagtaaaattaccctgtatgatactgtaatggtagataatgtccctatatggttgtctgaacccatagaatatacaataccaagtgaacccttatgtaaactgtggactccaggtgacaatgatgtgtcagtgttggtttcatcaattataacaaatgttcctctgctgcggaatgttcatatgggaagaggccatgcatgtgtacaggggatataatgggagatctctgtactttgcttacaattttgctgtgaatctaaaactgttataaaaaataaagtctacttctaaagaaaggactcaattgttaataaaactaataaagtatgtgtgggacatctaaatagacactactgcaaagaagaaaaaggaaggcaaataagctcatttaaaaaatgctcaacttcattaatcattagagaaacagatgttaaagcctcaacaagatatcactatatagttattagaaaacataaaattaacatgattgcatacgaagtgtcagaaggatatggggcaactggagctctcatccctgctggtggtggccaaccgtaaaatggtccaaccactttggaaaacaggcaggtggtttcacagttgctcacacacctaaccacacaatccagacattccacttgtggctatttacccaagagagagggaagcacatggtcacacggagacttttacacaagtgtccacagcaatttgtagtggtcaaaacccggcaataacctaaatgtctataactgctaggtgcataaaccaactgggaatacccatttgagagaatacttcccagcaaaaagaagcaatcacctactaatccagtaaacaacaatagttatgccagaccaaaagaaagtgatattgcataatcgactccatttacatcaaatttgtaaacactgcaagctaatccgtagtgacaggaagcaaatcagtggttgcctggggagggggtagaggacgcttggcgggggtgggctgtgatggctgtttggtatcgtgattgtggtagtttcatgggtgtataaatatgttaaaacttacgaaatgtacacttagaatgcataatttatggtatgtaaattctacctccatacaggcaggggtgacaccctctgcacttcatgcctcgcccaactcacctgcccccatgacgtgacactgaatgatgagcttcaatcccgttcatgctttcacaccatctccgtgctcctctgaacccacaaaaattcctgtgcttcagctttacacacccccaagctttatatacatggtatcaccttgcacaaatttggaaatacgcttttataaacattataattttaaaatttattcttgttggaatatgtaggcctagctcactgtaacagctctggtactcactgtgtgtatataacacaacgtatttattctggtgacaaatattttagcatgtctttttaattagcagttcagttacatgaagggtgaaaacagcccttgactcagacatactgggacacgcacattgtgtttactgtgacattaaaaataatctggaaatgtaacttatgcaacttaacacaagagctgcactattcaaaggaaaatcattcagacaatcttgagtttaatttgtaaaaagataaaattaaatattcatcaaatatctgctgtgtgtctgagtctctgctaggtaatttgggcacaagatctaaacataagatgaggccaggcatggtggctcacacctgtaatctcaggactttgggagactgaagtgggcagatcacttcaggtcagaagtttgagaccagccctgccaatgtggtaaaacctcgtctctactaaaagtacaaaaaattagctgggcgtggtggtgcacgcttgtaatgcccagctacttgggaggctgaggtaggagaattgcttcaacacaggaggcagagttgcgatgagctgagatgacaccactgcactccagccttggcgacagagtgagattccatctcaaaaataaataaattcattcgtccattcaacttaatttaaaaaaaaagtaagatgagaactttgctcctgcggacctatttatgacattttcatcctcttaagagctacaatgaatgcaataacttgctaactatattcttgtcacataggttcttacaaaggcatgtacatttctgtccaaaaatcgagtgaaaaaagacaaaatgagaaactaaagagctcagtgcaaatggataaaagttaagtcataaaaaaggcgggaggagatgggacgaaataggtgacaagcctgccctggatcgcctatgggcaggtgggctctgttaagcaagcacacagagcaatttaatatcctcatggttggtggaaacgaccccttgccagtaacaatcaactgagaaatcatcccagtggggcagcagcgtttgcaaggtctgtccgaaaaggaataactaaacctgaaactcctaatcataaccaaaaagacttcagagtacaaacagggacaagaatgctgctggcctttcaaagatggggcccaattcagctggcacagacaacagcttctgttctgcatgatgacaccagggagcacggcgccatcctgggagacagcagtgccgctctcagaactcacagtcaatggtaattatgtttgtcagttttttcactgtctccaataatttaataacccatgctatttgtctaaaaacagaaaaacataaaacttttattttatattttatttgtgaaaagaaaatccaactaagttctcatgtaagatgctcacttttttatactactgtaaagtcaaattcatacaagaaaaaaaaaaaacctgcacagactgtcgtcagtacagataagccagggacaacgtgaaaacccttctatgtgagtataggcagtggacttaattgagacttgaagtcaggcttagcaatgtccaatcactcaaaactatgtaggggcaccatccacacttaatgcttaaacactgtttgatgttgccaaacttcaaagaaacaacttcactcacaacataatttttttttttttttatgagatggagtctatctctgtcgccaggctggagtgcaatggcacaatctcagctaactgcaacctccgcctcctgggttcaagtgatttccctgcctcagcctctcaagtacctgggattacaagcacacaccaccacgcccagctaattttttgtattttagtggagacagggtttcaccatgttggccaagacagtctcaatctcctgacctcatgatccgcccaactcgacctccaaaagtgctgggattacacgcgtaagccaccacacctggcccacaacataattttaagaaaaattgcaataattatttcatccgaacataaacaggaagttgcaatttgaaagaaaaacctctagtggtaaaactgtaactaaagtgtattttactttaactataaatgttatttttattttgtttttcatgaatgaaacagctatctttaaaatccccattaacaagattcttttctacttcatatgtcccaaaacttgtttgaggtttcataacgggttcaactggcattcccagggactatcaggcgctactccagaattattggacctgggcagaaaggaacggaaggccagaaaagaatctgattcgccatcaaggaccttaacgtttgatggctatagatttaaaggttcatgctgataagacaaatactctaaggacaagtattattaatttaaattgtcatttacttacatcttagcacttccacaatcaagtccacatcagtgctgagcttcttgatgtggtcgaggttagccaccgttgtgattggcacatactggtcactatccatctgtgatataagatacatgtcactagcaaggttctccctgttgaaagaaaacaatctcttttaatcagtatttctttaaaaggaagtttcacctactgtaattccagtttcacaagaggcgtgagtgtggcatggtattgctttggagttaaatctcagcccaggacccatctgttatttgctgtctctccagcctcaggtacatttttgcaaaatctcggccttggagaggcagggagtgcaaaagtaaaagtatactgtactttctacaatcaaaatttatgagaagatggttatttttaaataagatgtaattatttatagctgtcatttttgtcctaagaagtagcttaagagtttattaaaaatgcatacaattttgttaggccgggcacggtggctcacgcctggaatcccagcactttggggggccaaggtaggcagatcatctgggttcaggagtttaagaccagcctgaccaacatggtgaaaccccatctctactaaaaatacaaaaattagccaggcatggtggcgggcacctgtaatcccagctactcgggaggctcaggcaggagaatcgcttgaacccgagaggtggaggttacagtgagccaagatcacaccactgcactctagcctgggcgacaagagtgaaactctgactcaaaaaaaaagaaagaaaaacaatttaaagtaaagaaatccagctcaatgaacaagaaaggaaaacataaaaaggccaggataaggtcatacccaaaattcctcctgtagactctggaacactcaccagagggcctatatccagccctggcttcctagcagccagaattaaaaagaaggaaacagtaactttacccacaaaatccaaaggtgagccacaaatcatcagcagtttgggccatgatgagctattttctggtgttttggccaaagatcaatgtttcctgtgaattctcaaggcatcatgtaatgtagtgaacaaggccctaagaaacatttcaaaactgagcacagtgctgggttcctggggcctctgctcagtgtccctcggtgaaggcccatgactgccgatcaaacggaggccatgcaggaggaggccctgctccaccctcatctcggccatcttccaggtgtagctgattctggccccatggggctacacatggatgtgagtggcagagagctcacacttgtgctccactagggcgttccactggtgcccctgcaccttttgcgtctaccatgtcatggtgcggtattctcagactccaatcgtggaacagcatgggcatggggaggaggccagcagagcccctcacacctccacctcatacaccccacaggcttcaaggagcccctagcagacacctgtgtggaatcctcagggctccagagaaaacacctggaaaatcatcatcgacagaaaaccttatacacggcccatcggttgttgtcatactcagagaaattacatcaaacccaatcccatcctcctttatgtccagttctgccattggaactttaaaggttttactaagaaaagggtattattcaggggaaagaaaaatgattaaaaatgagtgttatataaataaaacaacttgctatctcagtgtctggtgtgctttcagaaacaacgtggcacacttgttctccaacttcagtgtgaggaagtctgactcggcagcacagggcgggcggggcactttagacgcattccagacagtgaccaccgagaccactggggaccacagacatgaaggttacgttccatgctcaaatgtcaaaagactgtcattactcaatattccacgtcttcatatacatatatatggatatgagtagatactccttcataaaatatcacatttgtatatactttaactatttgcacaatactagaaatatcaggtactagaaaaaccaccaccagccttacctagataagcagaattccaatgtttttttaagtacttctcgggggtcttcctggctgtctggttgagactcatttcctcctacataaaagtaataatcaacttaggaaaaccggcttaaaatttaggaagcagataattcagtacagcagttctaatgctttcaacttacgttctgacacaactacgtaagtgtatcctaagtaagaaaaatgctactttacctatcaaaaaagtaaatcatgcaaaaaaacctatccctttatcccccaaaacaaaaacagcacagtttagaaaaataatctaagtctcattagcagagttcagcaggggctttttctaccagaaatgacaagtgtaagcttagttaatgccttgtctcactgcaaaaagaattttcaagtaacctacacaaacacaaaccctaaacaataataaaatacagaggaaaaaattaaaacaacaacaacaaagataaccagcaaaaaaccaaggctggagatcaaacaggctctaggactagacagtttctacaacagaggcttcaatttgccttccaacttccagagtcgaaggaacaagtgagaattgtcatgttacagaattcctgtaagagaatgataaataaaccagatcttcaagaggaaacaaaagctggttctaaatcctggaagaaatttctaagaagatgccagagggcatggtgtgtgtggtcacaggcagcacagggctgtgaatttggagctctagaagacactgcataaactgctggactccggacactgcataaagaggtattttaataatgttgcgatgacaggcactgaaatgctaagaactaagtttttcctgccttcctatataaattagcatggtacaatcatataagagccatgctaacacaagagacacttgtatcttaaaagtcaaagttaaagaccatgaaaaggcaaagacaaagtggggcgttcaggacaaatgagagggatagagagtttgtatggtgttatacaatgagcttagtaaaaatccacccccatcagcaaaaagaaaccaaaactgctaaagtaaccataacacaaaaccaaatcatgggactcaatgagactgaaaatggaaaattgaaaacacaacctgatgccactgtccatctagactaaggtgtctccgggtcactcatctaaattcacactccactccccatgtttaataggtatttactaaatatttccaagtgccaggcactactgcaggctctgtgaattcagcctgaataacgcaaagcctgtgctctcgtgaagccaacactctggtgggagaggcagataacagacagttaaccagtaactatacacatcatgtcagagagaaacggacactgaggaaacaacccaggatgaggggcagcaaggcctggtgccatccagacaggaagtgccatatgatctgatagaggaggggtggggcacacaggaaggtgggaagtgtgttctaaatggggagcctcaagcacaggggtcccaaggtggggcctctcaaggggtagagtccagcagtaggaggccagcacagctgagaagaggggtgacagacacagtaagaaatgaggtcacagaggccggtgtgtgtgagtgagatcaaggaggacgttaaagtaacctaaacgtaatagaaaatcaattcaaggctgacattttgaaaatatctctctggttccatggtgtagacagactgtgcaggcaccagccggaagataatgcaatcactgaggacagggcactagggaggactctccaagcgataggtggtgccgaagccacaagggaaggaagaaaagcagcccaggactgaacccgggacactcccaccttcagcaggaggcaagcgcatgagggccaagggacacaggctcacagccagcaaggtgggaagaccactaggatactgtgaagttaggagccaagagaatcatccactataacatgacacagtagagccaggtaagttaagaagttgaaactaactactagatctggctgcaccagggtcattaaagagctcgacaaatgctgcttaggacaactgtctacctggactggactcaagagggaatggaagcaaggagacctggactgcactcaagagggaatggaagcaaggagatgggacagcaagcagacagctgaagtgttctacagtggaagatgggctgcccggggtggcttcacctaagatgagagataataccaccttagaaagatggggagtgacccaaccatgcaagaaacacccggcactgcagacagaggacactgaggagcaaagacaatgacaagtgagacgggctctcagggagactggaggttgggcacatggtgttggtaagacacaggccatctgcctccaggtagatggagtcacaggggctaggttaactttccctttaaaaccaccaagaaaccaaataagacagatgaaatgacagttttccagatgtgggacatagagcaacaaaggacatagattcctatgtgacatgaaacttttttcttttttttttttgagacggagccttgctctgtcacccagactggagtgcagtagcgcgatcttgcaaccttggctcactgcaacctccacctcccgggttcaagtgattctcctacctcagcctcctgagtagcggggattacaggcgcacaccaccaggcccagctaattttttttggtatttttagtagagacagggtttcaccatgttggtcaggctggtctcgaactcctgccctcgtgatctgcccacctcagcctcccaaagtgctgggattccaggcgtgagccaccgtgcccagcttgacatgagacattaaagtaacccccacaagtccagcccactgccctgagggaagtcccaggctgtgcccagggagtgggaagtcaggtgggaacccagtgtatggctgtgtggaagagaaaaagagaatgcaggagatagggaggctgattgcataggccagacagcaggaggagctccagagaaccacagggcccaggacccatcacgttgtcagccaggttctttgcaaagcacggatgtgatgaaactacccaaggctcgtggaagaaccacctgaggggatcagaagtataacaatatatgtcattcacgtgcagagcctgaaatggttaaccctccccaccagaaactcttgtgattcccggagccctgcctcggtgataggaacaggccccacacagcaccgtcccactcacacctaacatcttaaaaacaagatatgaaaggatcacactgtttccaagaaacctggctgcatcccagaacaaatatcaaatatttaaagaaatacaaaaatactaagccctgaatacagtaaaactcaatctaaccaaaaattaccatgcatgcaaagaaagaagcaggaagatatgacccatgacaatgagaagtatcaaccaacagaagccaatccagaactgacacagatgttaaaattaactgaaaaggatgttaaaagttatcataactgtattccatatgttcacgaagtcaggtaaggacataaaagttattaaaaaaaaaaaagaaaaaacttatagagatgaaaactccaatgtctgatattaaaaatacttgatgagattaacaacagggtaaacattacagcagactcgggaacctgaagacacagtaacagaagcttcccaaaatcaaacagaaaaatgagaagcacaaccagctgagaggatcagcaagctgcggacaacatcgagcagctgagctcaagtgtaacagcagaccctggtatagtcagccctcaacacagagaaaatctacacacaggagtagagagcaccagaaaccgccatgacatggacaaacacgtatgctgttttgcttgttacagtttcaatctcttttaaaaataactgacttttaaataaaaataaaaacatatattgtcagtttatagcataagtaactgcaaaaggcatgatgaccaaagcatccgggccacgagagaaacggcggcagactgccctgatgctgtgctctatgtgaagcagcacgcagccacctcaaggtagactgtgttagccggaggaagtggagcaaaacgcaaagaaatcattaaaacagcgaaacaaagaagaaggctgctccaaaggaaaacagaaaaaaagggaaagaggaacgaagaacacatgggacaaaaagaaacagaacacgtctagcactcaatcttggtttctgatatcactgtccaatgaaggacccagcgctccttggagaaatggctgattctaaggctgaagcaaggagaaacaaaacaaaacaaaataaccacaaaaaaaccctatgttgatggggcatgtcaaagggagccgaccagaactcctgatggccaaagctagaagaacaatttgagcaacaaaataaagcagtactggattataaccaaaagtataaaacaaacattctggaatccacactgctataaagagttgaataagtaaataaataaaggagaagagacaaatctcccatacataagaattttaaataatttacgaagattcgtgtcctcatggagggggaccataaatccccaactccttaagtgtgggctgtacgcagcgacttccttccaaacagtacaacatggaaatggggagggaaagggtaacttcatagtgagaaacccagtaaacagccaggtgatcaagatcaacaccaacagtggtaagtcacgttgacaatgtgcacccttgatatatgtgataaaagtggtgttttaccttctcaaacccattaccactatagtatcataatgaggaaaacatcaaattctaatagaagagaatgttgttacaaaatacttgactagtactcttcagaactattatatcaaaactaccacaaacaaggaaagcctgggaaactgttacagccaagaggagcctaaggagacgtaacaatgaaatataatgtggttctcagctgagatcccgcaacagaaaaaggacgttaggttacgatgtatcactactggttcagtgattgggacaaatgtaccatattaatgcaagatgtcggtaataggaaaaactgggtgccaggtatatgggaattctgtgtgttcaatcatctcaatttttctaagtctaaaactattctaaaacaaatagcaagatgagagacctaaacctaaccaaagcaattaccacactaaatgttaacgttctaaatagaagacaaaaaagcaaaacccaaatgttatgttatctacaacaaatgcactttattaaatacacaaatagcttaaagtaaaaaggatataagatataccatattaaggctagtcaaaagaaacctggagtgattacattaatgtgagacaaagtaaattgagagcaaagactattactaaagataaagagaggggtcaatgaatcaagaggccacaaaaaagtcttcaaaatacgtgaagcaaaaactgataaaactaaaaggataaacagacaaatgcaaaaattaacagaacctttctttcaatagttgacagaacaagtagacagaaatcagaaagagtacattaatcttgaacactaccactcaacttgacctcattaacactgacaaaatattccccatagcaacagcaaaacacatattcttctcaaggacaaatggaatatttaacaagacagcccatatttgaagccataaaataagacttaatatatttaaagaaattcaagtcatacaaagtatgttctttgaccacaatgaaattaaactagaaattaataaaagaaagatccctggaaaacccccaaatatttgtaaactaaatcaaatatctctaaattatctatgagtcaaagaaaaaaaatcaaaaaagaaatacagtatttggaagtaactgaaaatgaaaacaatgcatctaaatttgagagattctgcttaagcactacttatggggaaaatagtaaaactaaatgactatatcagaaaataagaaaggcctcatattaatgagctctgcttccaccttaggacacagaagaaagggtaaattaaacccaaagaaatcgtaagagagtatattacaaacatcagaagaaagaatgaaataggaaagagtaaaacaaatgagaaaaatcgataaaatgaaaacactaactttttttttttttttttttttgagatggagtttcgctctgtcccccatgctggagtgcaatggtgcgatcctggctcactgcaacctacgtttcctgggttcaagcagttctcctgcctcagcctcccgaggagctgggaccacaggcgcccgccaccacaggcggctaatttttgtatttttagtagagatggcgtttcactatgttgaccaggctggtcttgaactcttgacctcacgtgatctgcccgcctcggcctctcaaagtgctgggattacaggtgtgaaccaccatgcccaacagaaaacaccttttgataaggtcaataaaactaacaaacctctacccagactgattgggattataaagaagacacaaattaccaataacagagatgagtgatgtaacatgactacagatttcacaggtgataacagagtattatgaacaactctgtgctgtaaatcccacaactcagatgaaatagaccaaatctttgtaactatataaaccaaagctccctcaagaagaaataaatgagtagcactatgaaaaaataaactgtagttgaaagctttcccacaaataaaactcctgcccaggtgggacgcagtggctcatgcttgtaatctcagcatctagagaggctgaggtgagcggatcgcttgagctcaggagtttggagaccagcctgggtaacatggtgaaactccatctctacagaaaatacaaaaataagccaggcgtggtggtgtgctactgtagtcccagctacttgggaggctaaggcgggagaatcgcctgagaccgggaggttgggactgagtgagccatgatgatgctactgcactcaagcctgggtggcagagcaagactctgtgagcaactaaactaagtaagtttagtaagtaagaaaggaaagaagaaaaaaggaaaactcctgcccacatgacttgtttcacttcctcatatgagggtgaaataatacgtaacctcttccaaaaacttaaatagaaagaaaaacactgaaatgaaaactagaaaccaagatcccaggtgtaaaaattctaagcaaagttttggtaaatggaatccagtagtatatccaaagtatactgtatcatgatctacagaggtttagaccacaaatgttggtatcacatttgaaaaacaattaatacaattcatccgaacacactaaaaaacaacaaatatatgcccatctccatagatgacaaattacaatattcattcctcataaaaatctctcagcaaaccaggaaaagaagagtgcctcatcaacatataaagggcacagacctaaaaccaccactaacgttatacttcatggtgaaatactgagtgcctcttgtaagaccagagacaacccaaacgtttgttcattctttccacttctgttcacctttgtactggagggcctatctagtacaacggggcaggataaagaaataaaaggcatcaagattggagagaaagtaaaacagtcttcattctaaaataatccaatcatctatgtagaaaatccaatgtaatctacaaaaaagtgtctaaaactaataagtgagcataacaaaatttctgggtttggactcaatacataaaaatgaatgctttgatatactagtaacaaacaactgcaaatacaaattttaaaaatcacttacaatagcaccaaaaaatataaaatacttataaactggataaaagatgtaaaagaccagtacactgaaaaccaaaaaatacttctgagagaaattaaagatctaaacaagtaagagatacatcttgttcatggatattgttcagatgtcaatgttctccaactgatctatagattcagtgaaccccccaacaaaaatctcagcactttgtagatattaacaacctcattctaatttgcatggaaatacacaggaactggaatttaaaaagtaactatgaaaaacagagttggaaggctatcactacctaatttcaagaattattaacagtacaggcatacctcagagatatcatgggttcagttccagagtgctgcaatcaagcaaatattgcaataaagcaagtcacacaaagttctgttttcccagtgaatataaaaattatgagtacactaaactgttgtatatttaatgtgagatagcagtatgtccttaaaaaaaaaactacaataccttcatttaaacatactctattgctggctgggcatgctggctcaggcctgcaatcccagcactttgggaggccgaggcaagtggaacacctggggtcaggagttcaagaccagcctggctaacatggcaaaaccctgtctctaataaaaatacaaaaattagctgggcatggtggcacatgcctgtagtcccagctacttgggaggctgaggcacaagaatcacttgaaccctggaggcagaggctgcaatgagctgtgatcatgccactgcactccagcctaagtgacggagtgagattatgtctggaaaaaaataaataaaaagaatctattgttggaaaatgttaacgatcatctgagccttcagcaaataataatcttttttgctggtcctgccttgatgatgagggctgactgttcaggatggtggctgctgaaaacttgggtggctgcggcaatttcttaagacaacagcgaagtatatcacgtggacggactcttgctttcaccaaagatttctctgcagcgtgtgatgctgtttgatatcattttgtcaacagtgggacttctttcaaaattagtcaatcctctcaaaccctgctgctgctttatcagctaggtttatggaatattctaaatcctttgttgtcatttcaacaatattcacagcgtcttcaccaggaatacattctaactcaagaaaccattttctttgctcatccataagaagcaagttttacacattcaagttgtacatgagattgcagcaattcagtcatattttcaggctgtacttctgattccagttctcttcctatttctactacctctgcagtgactttctccactggtcatgaacccctcaatgtcctccgtgagggctggaatcaacgcctctggttaatgttgacattttggccttccctcacgaatcacaaatgttcttaacagcatctagaatggtgaatcctttccagaatccatcagaggaaccatgatctatacagctagagccttatgaaatgtattttttaaataagaaaatttgaaaacacaatgactccttgatccataggctaccgaatggatgttgtgttagcagccatgaaatcaacattcatctccttgtacacctgtcagagctcttgggtaactaggtacattttcaatgagaaattaaaatctgaaaaatatctttgtttttttttttcctgagcagtaggtctaaacagtaagcttaaaatattcagtaaaccatgatgtaaacagatgtcctgtcatccaggctttgttgttccacttaaagaacacagggagagcaaatttagcatcattcttatgggccctaggattttcagaatgggaaatgagcactggcttcaagttaacgtcaccagctccattagccccaacaagagagttggtttctaatgttgaaaccaggattaacttcttctctttagctatgaaagtcctagataacatttccttctaatataaggctattttgtctcgattgaaaatctgtcatttactgtagccatcttcatcaattatcttacccagatcttctggataacttgctgtttcaccttgcatttttatgttatggagactgcttcttttctttaacttcatgaaataacctctgtgagcttcaaacttttcttctgcagcttcctcacctctcagccttcacagaacttaagagagttaaggtcttgctctggattagactttggcttaagggaataattgttgtgactggtttttctatccagatcaaagtttctccatctcagcaagaaggctgttttgctttcttatcatttctgggttcactggaggggcacttaatttccttcaataacttttcctttgcatttacagcttggttaactgtttggctccagagaccgagttttcagcctatctcagcctttgacattccttgcttactaagcttaatcacttctagtttttgattaaaagtgagataagtaaaactcttcctttcactggaaccctcagaagagggaatgtagggctattaattggcctaatttcaatactgtcatgtctcagggaataggaaggcccaagcaaagagagagagagacaagggaagagccagttagtggagcagtcagaacacacacgtcatttatatattaagtttgccaccttaaatggtgtggctcctggcaccccaaaacaatggcagtagtacaaaacaccaaagatcatcgatcaccactagcattaataataatgaaaaggcttaaaatattgtgagaattatgaaaatgtgacacagagacatgaaatgaatacatgctattggaaaaatggtgccaattacttgcttgatgcagggttgccacaaaacttcaatttataaagaaggtggtagctgcaaagcacaatgaagagtagcacaatgaagcaagctctgctgacaatccaagcagtgcactactggagtcaaagcgggctagcgcatcaatgaacagaacagacagtccaaaaataaatccagacctacgtggacaaacgacttctgagaaaggtgcaaaggcaacgcagcagagagaagtctttcaacaaacagtgctgcaatagctgcagattcctatgcacaaaatgaaaataactttgatccatatttcataccttatacaaaaactaacctaaaatggacctagaaatgtaaaatctaaagcaattaaacttataggaggaatataaaccaaaaggaagagccataaaagaaaaaaatgataaacttgattacacaagaaattttaaactgcttttcaaaaatactcttgggagaacaaagtacattgcgtatctggacttatatccaaaacatataaataactatcaaaagtgagtaataaaacaacccaataagaaaatgcacaaacaggcacaacaccaaataagatatatgcattacaaaaaaatgctgcaacttcaggttctgcatgtgagaagcctgcaagttatcactctggtctgacaagtaaaaaatctaaaaagaacaattaacaactcttcttagatcctacgtaaagtcacaaggcaaacaactgctgccaaattggacagacagacagataaatagagaagcgatcacaacatatggagcagaaacctttgcaggaaccaaggcgaggacagaaaacactgtcctggaactgattaactgctggaggctcagggtggccaagtctgagagttaaaaactgcagggagtctcagtcattggcgggtgaggggttcctgcacttttgtgacttatactttctggagctcgatcaggtcctcacagggaatactagagaaaaatccctttgtgcttccggcacgagtaggagaaaagtaaccgttttgaaaaataccagagcactctgttcttcttaacaaggtctgccctcaggaaagacagtttaaccacagtccaacttgctggggtttaatcagagcagaacatacctagaggaagggaaacacctagctcctgcctcctctggtcatgctgccccacctaagaggggaggaaagaagagaagctcctgtgagcttcacagtccagggcccgggctcactacagacttgagactcccaggcctcttatggaaggcgtcccctgcccacacctcaccccacagcactgaaggcatagtcaccacagtgccttccacccagcacgtcacagctggctctcaagaaagttacaaggcatacacaaaggccaaaaacacaatgtcaagagcagagcaagcattagaaccaggcatgacagagatgtcagaattatgagacagggaatttaaaagaactaggataagatgctaagggctcaaatggataaaggagacagcaggtaagaacaggtgggcaatgcaagcagagagatggaaatcccaaggagggggaaaaaaactgtgagagatgaaaactactgtaacagaaatgcagactgcctttgatgggctattaggagactggacatggatgaggatctatcaacagaaacctctgctggcactcagaaaacaataccccaaaatgaaggcctcagaaacaaaagttttttgggtcttgttttatgtccttgagagcttgaactgtgaccaagtgggagcactctttggtctccaccattgggggaggtacgattttcggatcaggtcgggtggccggtctgaagacaggaacccaagactttttgttctgcatacgtcaagcgctcgggagtttgtcttaataagaggtcccacgtgtaaggggcttttgtcatctcaactcctgctgcctggttagtctgtgtcaacaagagtctttgctgattgagctcattcctgacagtaaatgttttgtgggaggtatctttggaattgcttcttctatgtcctctccaggatctatcctggactttatacaccactgaaaattctaaatgtcaatggccaaaagatggatcctttaaattagaattgtaaatttaaaaaaggattttagaaatctcatcctaaacaactgataaaaacatcaagagcaaaaagggtgcttggcatcactaaccactaggaaatgcaagccaatttctagaaagacccaacaatgctatggttagccttaaaaattctctttaaaattaaagagcaaaaatctgacctgaaacaaaattaaaaattttttaagcttaaactcctactttggatccccctgttggttaacaatgagggctcctctatattcttgtaggcccacagttaaaattccaggctttccctgcggtggcctattagacacacagcccaatgcaacagaagagagggccgagaaagaaatccttgcatacatggccaattgttttttttaacaggcgtgccacgatcgttctatagagaaagggcagtcttttcaataaatagtgcaaggacaactggatatccacatgcaaaaacaaagttggatccatactttataccatatacaaaaattaactcaaaatgatcaaagatctaaatgtaagacccgaaatgataaaactcagacgaaaacacagacaaaaccttcattataataaattcaacaatgttatcttagatatgacaccaaaggcataggcagcccaacaaaaaataaacaaactgaacattatgaacattttaaattttgtacatcaaaagacactttgaataaaataaaaaggcaacccatataatggaagaaaataattgtgattgatgtatctgatcagggattaatacacagaatatattgagaactcctaaagacattaacaaaaacctgattcaaaaataggcaaaggatttgaatagacatttatccaaagaagacaaatggccaataagaacaaaaagggtgcttggcatcactaaccattagggaaatgcaagccaaaactacaaagatatacccactagaatgactactatcaaaaaaatcagaaaataggctgggcgcagtggctcatgcctgtaatcacagcactttggcaggccgaggcagacagatcacctgaggtcaggagttcgaacccagcctggacaacatggttgaaccctgtctctacaaaaaatacaaaagttagctgggtgtggtggctcacgcctgtaatcccagcactttgggaggctgagatgggcagaggtcaggagtttgagaccagactggccaacatggtgaaaccccgtatctactaaaaatacaaaatttagctgggcgtggtggctcacacctgtaatctaggctacttgggaggctgaggcaggagaattgcttgaacccgggaggtggacgttgtagtgagctgagattgctccagtgcactccagcctgggcaacagaattattccatttcaaaaaaaaaaaaaaatcagaaaataacaagtattggcaaggatttaataaaactggaacccttgtacactgatggtgggaatgtaaaatactatggcctgtatggaaaactgtatggtgattccaccaaaaaaagttaaacataagaattaccatatgatccagaaattctacttctggaaggcagttcagcagctttctacagaactaaacatactctgaccttatgatccagcaatcacactcctgggtatttacccaaaggagttaaaaacttccttccgtacaaaaacctgcacatgaatgctaacagcatctttatttgtaattgccaaaacctggaaacaaccaagatgtccttcagtaggtgaatgactaagtaatttgtagtatgtccagacaatggaatgttattcagtgctaaaaagaaatgagttatcaagccttgaagacatggaggaagcttaaatgtacgttactaaatgaaagaaacctatctaagaaggctacatcctgcaggattccaaccctatgacattctggaaaaggtaaaactatggagacagtgaaaaaaccaatggatgctaggggttggggggagggaggggtgagtaggcagaacacagatgacttttagggcagggaaactactctctctgatgctacaatggagggtacatgtcattatacatttctccaaacccacagaacgtacaacaccaagagtgagccctcatgtaaactgtagactccaggtaataatgatgtgccaatataggatcatcaattatacaaaggcaccctctggtgagggagtgtgaatagtgaagaaggccatgcatgtgtgggggtgggggggaggggagtatatgggagatctctataccttccactaaaactcgctgtgaacctgaaagtgctctaaaaaaaacagtcttttttttaaaaaggatgtttgatagcattagtccttagggaaacataaattaaagccacagtaagattctactgtctcccttttacagcagctaaaattaaagactgaccctgaggtcataagggtcataaggatgtggtgctttaatccaccactggttgagaatagaaaatggtaccaccactttggaaaactgccttaccatttcttaaaaggataaacatgcctaccagatgatccagctactccattcctaggtattttacccaagagaaatgaaaacatatgtttatatgaaatcttgctgacaaatgttcacttttatgaacactttttattggcaaagccacattttgaaaacaatcccaaaatccatgaataggggaatagaaaaacaaactgtgatctatccatatcatgaatacttctcagcaataaaaataaatgattaattcatgttacaacatgaatcagtctcaaaaatagtaacctaagtcagacaaaaacagtacacactgtcaaattctatcacacgtctgttgtccagcaacttgtggggctgatgcacatctcttgggcccaggagttccatctttttttttaaagagaaaaaaaatctacgaaacgcaaactgacatatagtgatagaaaacagaccactgggccgggcatgaaggcttacacctgtaatcccagcactttgggaggccgaggtgggcgggtcatgaggtcgggagatcaagaccatcctggctaacacggtgaaaccccgtctctactaaaaatacaaacaattagccgggtgtggtggtgggcacctgtagtcccagctactggggaggctgaggcaggagaatggcgtgaacccgggaggcggaggttgcagtgagccgagatcacgccactgcattccagcctgggtgacacagcaagactccatctcaaaaagaaaaaaacagaccaccggttccacggagaaaggagagggcacaggaagctcttcctggtgtttgggatgttcgtgatcttgattgtgctgaggattttacaggtacagaacaacttatcaaactgggtggacaaagcaaagaggaatgaaagaggcaacacattaataatgtattatttcctcaattgtctgtaagctacagaaaatctggggtatacctgaagtatatgatgtttattgtacatcggttatgcctcactaatgctttataggagtgagagagggagtaggtggaggcagatgaaggaggaagacaaagcagaaggtattctttttcttctttttgaaaatagttttaaataccccttttaaaaagaatcaccttttgaaattaaactttccagaatatactttaacatgttgttatttcacttttgataatgttccctatcttctatcttcagatagattttaacatgttatttcacttttggtaacgttatctatctcctgtcttcaggcagattttcacaagttatttcactgttgataacattacccatcttccatcctcaagacagatcttcacatctgtctacctcctatctatcttccatcttctgtataaattctgaccccagttcaagattaggtcatttcaatttagtctgaaacttaaattgtttattttgaaccattttacttcctaccattaggattctcactccctcaatgtataatgcctttttatcttttgtaaaaatctgttttaatgatgagcattcctttcctttgccatcttaaattcaatggactctaacatgactccagtttatcccaatgttctgccattcccaagtcactaaccagttactggtgaattaacaagggggatgtaatcaaattacattgctgaatactggccttcctcagatttagaaaactgctcatgtagacgggaaattcactttatgcaaattcaagatggcaaatttatatttacaagaaacaagcatggcttaatttttgtacctttataaatacttgattcattttaccaaacaattatttaaagcaataagctccactgaagttaaaaaaaaaaaaaaaaaaaaaaaaacaaccgtcacagaacatctacacattttccctcttaagtgacagtttctgactttgacagtcttaagccaatgaagtcattctgcatggctgtgccttacagcatcgaggtctggcctctccagccctgcccagtgcattccctggtcactgggataacgaaaagcccatggcaagtggggtgggggaggggacagggactggttaagaacaattgtggtaataaaaatgaaaacatgagaggccgaggcgggcagatcacaaggtcaggagatcgagaccatcctggctaacatggtgaaaccccatctttactaaaaatacaaaaaattagccgggcgtggtggcagacgcctgtagtcccagctactcaggaggctgaggtaggagaatggcatgaactcagtaggcggagcttgcagtgagccgatgtctcaccactgcactccaggctgggtgacagtgagactccgtctcaaaaaaaaaaaatgaaaacatgaaaaagttcctgcatttccagtaacgtgtggtacactccataactgggcctgaacatctcctttcccacctactctcttcctttccgttttttagccactactacatactaaggtacttacaaccctacatgagaacaacagagattctatccagatggtcttacatttgctttcctccaagccattctttcacactcctgcaaaatttaccttccccaaacaacttattttcttcatgtcactcatttcctcatcaacaggaaagaagttcaaatgtgaatggcttctaagacttgcaaatggggcctcaattgcccctacctacaataccacagcattccctctctatccccctccctttacccaaactgtcttactctcaaatccaacattaacgttccacctctgcacttttactgacacttcgcactactaaataggtttcatttttttttttttttgagatggagtctcgctctgtcgcccaggctggagtgcagtggcacgatctcggctcactgcaagctccgcctccaggttcacgccattctcctgcctcagcctcccaaatagctgggactacaggcgcccgccaccacgcccagctgattttttttgtattttttttttagtagagacggggttttaccgtgttagccaggatggtcttgatctcctgacctcgtgatctgcccgcctcggcctcccgaagtgctgggatgacaggcgtgagcccccgcgcccggcccaggtttcatcttttgagaccttacattcctccatggcacctccctaaccagggcctctcatcttctctgcatccacataagggtgagtttaaagtagaattaaaagcaggcaaagaaagacccattgtgtagagaatgttaatactctaaataaaaaaaataaataaagcagcccatattccctgggaaaatgcacccataagatatgtttacctgtctcgctattttcaggcagagagtcatattctgagggacccagagcgagagcgttcatgtctgctgggtccgactcctgcgggtctggcaatgcggcattctcatggccctggtcaccatcaccattggcatccgatcctacaattaggagtttaccccaaaaaggcagggttagaagcataactttctcttaaaacaaagcttacacttgcagtgactcaacttctttagactgtaaaagacctctgggctctcaagcactgccacataccatgacacagttatgaatgaacaacatcttaaagacagattaaaatggcaacaaaagcacaggcctgaaagcagggggctgcacaccacggccatgctcaacttaccctgcgggccacggtctgcgtggtggccagccacctcctcccatgcagcactcacaccgtcagcagcactgcttgcttccagatgtaacacaggagccccccacacttctgcattagggttcagctctgaaaccttagttgctggtacctaggaagaaatgtaagatagacatttgtatccaaatgtcaaccaaatacaattttactcattaatgcagagttaagagacatcagatataggctccaaaggctcagcctatgtatttatacacacctttggaatgaaatcaggttcaaaattaaaaaaaaaaaaaaagcagtcagaattccattaaattccccccaagttttaagttcctcctcccaagaccaaggcttgcagagatggggaaggacacgcctgccaccaaaagattcagtgtttcacaaactatacctgaggaatagctggtgacttcctagactcctaataaaatcacaattcagggttttacaaacttgaatacaaggcagatgaataaaattctaattagaaagcttaaacaagtcagcagggcgcggcggctcacacctgtaatcccagcactttgggaggccaaggcgggcggatcacctgaggccaggagttcatgaccagcttggccaacatggagaaaccttgtctctactaaaaatacaaaattagccgggcgtggtggcgcatgcctgtaatcccagctactcgagaggctgaggcaggagaatcacttgaacccaggaggcgggggttgcagtaagctgagatcgcaccactgcacccaacctgggggacagagcagaactccatctctaaaacaaaagaaagaaagaaagcttcaaaaagtcacataaacaaaaggtgtagaagatgaaaattgctcctaagaatgaaggtgttctaacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacacaggagaagggctggaaaggaccaccatgagccgtcaaataaacgatgggtgcattaacaatttttaaaagacagaataaatccacattggctcaggtgatggggctggtagtaaaaaacatgaaactatttctgaaactgagagaaggcagctgatgtggtttgttcgttcctgctcccccagtcactggagcaccaatgagcaccatgcccataaaaccaggtgtttaaatgagtatctatctggaattctttttagtttttgttttaagtactggtgatagggcaaattattgggttccttcaagaatattataatcaagaagcaccaattcttcaattttccttcttgcattgcatctaaacttcatttttggcctctgcttctgcatagtgttacttgccctcttctctctcatccacccatctgtccaacaagtgcctctgacatgttcaccagcatgcttgtgccaggcacggcactgagctggcaggtgtgatggtgaaggaagcagacaggagctcatggagctacatgagggggcaggagacagccacaggtcacccacaacactgcctctggcagcgtttacgccgctccacctgatctgttgtctttgtaaattcatttctctattctctttcccactctaatacttccatacatcacctttcctaattagacccagtctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaagatatatgaggaatgaatcaatgtttaataaataacataaatttatattttccactatttgacaacttctgcaaggttttatgccacaaatgactaggactctacccttaaccaatgactacctcttagtgaagaagtccaaatcaagtgtatgcagttaggaaatgttcaatcaatgctgtgactgaagagatgtcaccaggaatgaaagaatgaagatgtcttttaaggcttaatgacattcaaggatctaccacgtgctgagcacattctacgcacttccttgtactgaatcagaacaagtcttggaggtcgttattcactggactcatttcacaaatgaaaaaaccaaggcagagaaaggtagagtaacttccccataaaaacgatggtaattagaaagttagattctaagcaattgcgttcagcaaaattcaacactcatcaagagttcattaacttataatttatgagaaatagtttgtattaaacaaagatctgaatctcctactatttctataaaatatggttattctcttgcagtaatatggaactctaaatggttatcaagaactccagcgtcggccgggtgtggtggcttatgcctgcgatcccagcatgttgggaggccaagatgggcagatcacttgtggtcaggagttcaagtccagcctggccaacatggtgaaaccccgtctctactgaaaatacaaaagttagctgggtgtggtggcacacacctgtaatcccagctacttgggaggctgaggcaggagaatcatttgaactcaggaggcggaggttgcagtgagctgagatagtaccactgccctccagcctgggtgacagagcaagactccatccttgaaaaaaaaaaaaaaaaaaaaaaaactccagtgtcgtctgcttgactataagtcttatttttccattaaaaatgtatggctaagcaatggttattaaaaccacaggcaagctgaccttaacagccacattccaaagtgaacatgcctgagttctgatgctttaaataaacccttccaccccaccccatcctgtgcgaaacaatatgctccactttgaaaaataacgtatcaattaataagcttgtataactaccgatacgagacagaacagtctctctgacaagttactgactaggaactggagtaattaatgctggagaagggggactggccggtgaggtacagaaagcaggtgagaaataggggaaagaaacattccatgcaagcaccaaccactcctacagatgcactaaaaagcttagtaattcagggcaatttgctgacttcagaaccatacaaggctctacctccagttctttgtgaaatggagtaatagctgctatattaagatttgcttaaaaaaaaaaaaaaaaaaagacacctgtaacagcactttgaaaattgaagctctgaaaggcaaggcaccatcgttaaacgtggtaacgcttcgtatgagaatactgtttgggaatacctcataatggaaaagctaatttaaaactggaagcacacctctcacttaggcatcatttatgctctttgttgatgtctgaggcagtgacactggtaactaactgaaaattatgtcacttctgtaaaagattaactgcagattatcttaaagatgtagttttatactgttttgcctccacaactatttaaggagcaaaactaatgaatttgaacataactctctccagaaaaactcccagtgtgggcacggaaataaaagaggttgatggatcattccttacactacagaaggggatttctacttgtttatttccatatagtaagtgttgacatttgagccatctctacctccttaatatcaatacttttccttgcttcattgcccacaaaaatcatgaataaaccactggttgaataatgagatcttgctactctgagtatgtgctttcaatcacactgcttcgataaatgtctgttttgtggaagaaaactaatttcctgttgttgaatgatgttgacatttattacagaatttctggaaagatgctcaaattagctgcccatagagtcatttgctaagcttcttccaaaccagagggacagccttatctcggggttctgaaaaagaaagagctccacagtaattctaactgcaagaagacagaaccaagatttcataggcagttaaaagcagcaaattctacctgcctcagacacatacaaagatataaggaagcacagatttttaggtaagtttgtcttctgcagtgtgacttataccttcaatgggctcacatgcttatcgaatcaactacactgcccacgagataagatgccctcaaagggctctgacaacactgcggccaggaagacagaagagctggcaaaattcacagacagaaaaaagtcaacacagagctcagggcatgctttagtgctaacaagagtttgcacacaacctctggcttaagtacaccaaacaagaattcatattctccaatttggaaatcattaatgttatagtaattcacagccatatataagcattcaaataactacccactgtttagagtaaatctttattaattttaagttaaaaacaattaaaattggccagcccggtggctcatgcctgcaatgccagcactttgggaggctgaggcgggtggatctcctgaggtcaggagttcaaaaccggcctggccaacatggcgaaatcccatctctaaaaatacaaaaattagccaggtgtagtggcacatgcctgtaatcccaattactcgggaggctgagtcacgagaattacttgaacccggcaatcacttgaacttgggaggtggaggttgcagtgagctgagatcacgccactgcaacttgggtgacaaaagtgagactctgtctcaaaaaataaataataataataataataataataataataataataataataataaattaaaatgtatagcccagcataccgcagcacaatagtaaacacacagaaaacatacttacgaactgtccgtctctatcatgccatccccaaacaacaccgtcctctgacaccggtagctgaggagtgttttctgaaaacaaagcaatttccaaggcctgtggcttatggtgcagatcctcactaaatattgtttcaccttctagagcaccttttgtgactgtattagtccagagatagcccatttgatatccaccacaaccactggccagtctttcagaaaatgctgggtttcctaaccctcccatcgggtaataggaaaattcactcaaaaaacgggagactccttctgggaaactctgccaatccacttttgagggatgttcacatctatttaggacaccttctgtgagtgataaaatgtggccactacttggtacaatcgtgtctttgctgtccacggggacagcgggaatcccctgcgctgcatcgcagggggcacctgtgtatctgtccgctagggtgggatcaacaccaaccagaaagaaattgccactgggagtgtcacgtgactctattttctcaaaactcaccttagcatttcccataaaacccatttcaccatttaaagtcgactgtgtaagagtggacttggcgtttccttctttgaaatggtgtgcacgttcactcgtcccacatggacccaggcagtcagtaattctggggtcaatactatctttctccaaataaagtctctcttcctcttctttacatgttagttttggtttactcaaccctgatgtattattaccaaagataccagaagcttcttcaattgattcagaggaaattcccttccattttgggcttttaccaccactaacagaattctctactatttctgacttctgtataactggattaacacttggactgaaatgtggtaacacactaagaacattatatttgcagtcgtatactcggtgtgtttcataacttttttctatttgattagtttcaaaatcagcgttctctgttgcactagaactaacacaggagagtacatcctgacttggcactgcctcatgtctttgtgtacctgtttcccactcataggttgttttagaatctgacttgacagtctctatgtcatcttcacttgtctcactatactttgcttgcagtgattctttttcactaccttctaacctttgagggtcactcagctggtctcgtgacacactgactgaactcttcacacatatttcaccctctgttttgtcacctgggcttgtttccctctcttcttcctctgtgcaggtgaaaataaatgcggaggaaacacagttactgtgaagagatctggagtgactgggagacttgccatcggggggcactccttgtgccatgctaagctttaggccatctgtcctctgcaccgtcccctgcgtgtccaccacacgctccacacaagtttggtcacaggtctgtgttgcagcctcatctgcttgacaccaagattttgactcaaaagcccttacaccatgaccctcagccttccaaacgccaattctgtcctcttcttggtaaaaggcactattttcagattgcagagacacctcacctctgtctggcagcaggggacttctggcctccaggctgcagtcccctctgcgctgtgccttcctgacttgtctggggacaggttccggctcccagcagtcatcaagctggcttggggctgcttctcttgaattagcgtgacctgagagacacccacttccaaatcttactgcagtgataggcctcttaggacttaaatcaattctatctagaccaacaggaaggatactatctgctttgttaacgtccaagtagaaatcatcgttgtctcttagtggtgtgatagagttattttctctctcctttttagaatgtaaactctggtcgacaacaactgttaccacctccgggtcatcactccctgcaacacatgcagtgtcagtacaaaagctaccaggtgaatgtgcagtgtcagtacggaagccaccaggtggatgatccatctcacttcctactcctgagttacagctctcactttctcccaggacacacgcatgacttagtgagtcactgtccatgttgttatttaattcagggagtaggtcaataccatgtagtgcactactttctgcgtaatttttagggaattcagtgcaagcttctgcctgtaaagcctccatctgcacgttatcagtgtttgcttcacaaggtgcatggctgaacgccacaggctcagggcaaggcttggctttcccactgcattcccctgtcctttcacctggacccagcgtgtcccaaggcgagagttcttcctgccgtggctctggctcgcccgcccctgacatggcacgcgaggctgaaggcactgaagagcaacactctcctcttgcagctactgtgtctacccaggtgcccagctcctctgccacgcttgggcaggcagagtcggcaacacaaatgctgtgaaacttgcactctcctgaatcctgacattgctgatcatcaataccaacagggtttccatctttcctctccctatcggataggtctaaagacttactctcatcaccactgctgaggtgaacgctgaccaccatttctttctctactaaagagtttttacaagtagctgggtaacagtgcagatggccactcacaaaggcttcctcctgcaggcctcggtcagaaggcaccagcacacatgagaaaagctcctcatcttcccaacaaccttgtcggctgccgttacccacacacagtagatcacagaccccctcagaattctgctcattaacaacaatatctgaattcttgtcattctcacccaagttttcataccttgttgagaatgtatatataaaagaggaaagagggttcaatgactgcttgggtctatgaccctgtttgtgcccagaccctgcgaaaatccttgtccgcgcgctaacgccagctacactgctggctccactgccagtacggtgaacctcctcacctttgacggtatcaaataatgaagacaaagttttacttatcttgttttctggttccttttcctccacagatttttgtaacaggccagttttttcactgtcattgtcactacttagttctctgctgaagcagcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatcccagccagaaagatttcaggcttctggtttttctacagtgttccagtatttcccaaattatatttcatgggatggtggtaactaaataaaatagttcataaattcccccaaaggaaaacagtatcagaattttgttccgtaaaatatatagctactcacagttgtatctaattttctagctttacgaaatgatgtctgaaataaatagcaatttaaaaagagacgaaaaaatcaaaggagagcaaaaaaataaatagcaataaaaaatagtatctgtaggtatcaagaaattattactaattgtgtcaggtgtgaaaatggaatgatgtcagttagagatgcatgctgaagtatctgggataaagtgacacattatctacaatttgctttaaaatgccctagcaaatatagtaaatatatacacacatatataaaagttaaaacagtcatgtgcatacagggaggaaaagatttaaagacagtagtccaggccggacgtggtggctcatgcctgtaatcccagcactttgggaggccgaggtgggtggatcaccagaggtcaggagtttcaagaccagcctggccaacatggtgaaaacccgtctctactaaaaatacaaaaaattagctgagcatgggagtgtgtgcctgtagttccagctactcggaaggctgaggcaggagaatcacttgaacccaggtggcagaggttgcagtgagccaagattgcgccactgcactccagcctgggtgacaagagtgagactccatctcaaacaaaacaaaacaaaacaaaacagtagtcgaatgtggcgatgggtaatgttcaagttaatgatgctgcatttggttcatggtattattcgctccacttctgcagatgtctgagcactccaattaagaaaaaggaaggaacaagaaaaaaaagggaaaatagatctacaagctctggtaccagaactagaaagtctcttgaaagtacttgatgcaggaacgcacagcctgccatctggtgaaaaacaggcgttgtccacaactaaacaagttgctcatgtactatgtggtccagtccctaactgtggactcacataatgggtcttgtcttacattgacatctgtgatgttttgcttttagtataagtaattctttttcttattatggttctgacaggctatgtgaaaaacaaaataattcttttagttcctctgcaagagagattttgttgtttctttaacctatgagttatgactggtgtcctattaatgttttactttttaaaaatattaacatttttatgataaaaagtttaggaattacacttaaacataaaggtaacaagaacacttatgaatatactaaaattcaagtactgaaatcatcataatgattatgatgataatggtagtcaacactttatatagcactatgtttcacaaaatattaattacatctatgcatccattttgtcacacgtcttaatttgcacccttaacaacccccaaggtagatactactaattcactgtacagataagggaaatgaggcaccaagaactttagtagcagcttcgaatgacaaaacaaaactcagaccatacattgaccatactgttatgctactcaaagagaattaaacatctacatggcaaaaacgttctgcactaaagacacaaacgattcataccagctgtaaaatgaaaggacatagtaaagcagagaagctcacgagatcacctgcctggctttgagtctcagctccatttttacatgtgtcatctctggcaaattatttaacctctttgtctcagttttctcatttgtaaaatggagccaacaccgacatctatttcaaagagctgttaggcagactttaagtagttggaatagaatctcagagtcccacttcaaagtcccccataatctggccccagcctacctctatgatctcggcttctaagataccattcccccgacctcttctatctcatactaaccaatgccagcacactgcctcaatgttgtttctttctccagtctcctccccacacttttcaagccttgaagtcctttgtgaaaccattctgtgctgctctaacagaatacctgagatggggcaatttataaagaacagagattatttcacacaattctggaggctgagagtctcaagtcgagaggctgcttctggagaggcctttgtgctgcaccatcacacatgtgaggaaatgcagtcactcccaccacaatggcactcatccactcctccacttgtgagggcagagcctggtgtccttatcaccccttagaaggccctacctcccaatgctgctgcacggcggactgattttccaacacatgaactttgggggacacatgaaaaacacagcattccattccagctcccacaattcatgtccttcttataatgcaaaaaatactcattccatcccaatacctccaatagtcttaactcatttcagcatcaacttaaaagtccagagtctcatctgaatcagatagggtgagactcaaggcacaattcaccccaagatcaattcctctccagccctgagtgttgaaagtaacaagttatgtgtttccaaaatacaatggtgggacaggcacacacacaaaaaaattcccgaccaggtgcgatggctcacgcctgtaatcccaacacttagggaggccaaagcaggcggatcacctgagatcaaaagttcgagaccagcctgaccaacatggagaaaccccgtctctactaatacaaaaaattagccgggtgtggtggtgcatgcctgtaatcccagctacttgagaggctgaggcaggagaatcgcttgaacccagcgggtcagaggctgcagtgagcagatatcacaccatcgcactccagcctgggcaacaagagcaaaactccgtctcagaaaaaagaaaagaaaaaaaaatctatttccaaaagggagaaataggcaagaagaagcaagaggtcccaagttcaagacccaacagggcagacaatattaaatattaagcctctctggagaatcatctcctttgactccatgtcccaaccctctgggcacagtggaacagggttggctccccagggcctcaagcagccccacccgatggctttgctgggctcagtccacccagcagctgtcaggggttggagtctcctgcccacagctctcccaggctgatgctgcaagctggcagctccacagtttaaggctcccaggccactcccatgactctactaggcaatgccctggtgggggcttctctgcagcaggttcaactccaaatttctgcttgccattgcccgagtacaggctctctgcagtggctctgctcctgtgacaagtctctgcctgggcccccaggctgtccatgacatctcttgaaatctaggtggaggctgccccacagctctagcattcttcttgcctgaaaaatcagcaccacatggatgccaccaaggtttatgacttgtaccttctggagccgcagctcaagccaccactgggcccactcaagcagcagctgaggtgactaaggagcaatgcacaggatgtggggagcagaggtccgaggcggctctgggcagcaagcctgtggagggcccccagtgctcatctaccaaaacccttctgccctcctagagggcaaatgtgatgggcctgtgatgggggaacagccttaaagatatctgaaatagcctcgccaacacagcaagaccccatctctacaaataaaaattaaaagttagctgggtgtgggggcgcgtgtctgtagtaccagctacttgggaggctgaggtaggaggataacttgagtccaaaagttcaaggctgcagtgagctattactgttctactgcactccagcctgggtgacagagcaagaccctgtctctaaaaaaacaaacaattctgaaaagcctttcagatggctgaaagagctgagtgttttaaattatttccttctggtttctctttttaaatgaaataacggtgccaaatacaaagtatttcctcttgagtttggactctgaagccagattgcctgggttcaaatcctggttctaccactttttagtccagtaatcttggggataaattacttaaacctctttgtgtctcagtttcctcatttgtaaaatggggataacagtacctaggggtaagacaggtgtagggctaacaggaatttatgagtaaacggaagtgttaggagagtgcacagtaagagccatgagagtctgcagtgattaccaccatatgtgatatattcttttacactggagacatttatggagcacctacctgtcaggaagacactggaatacatcagtaaacaaaactaaaccccagatttgatggagcttgcattctagtccagggagacaaacactaaatctaacaaatacctaacattgttagaaggtgctaactgctacacgtaaagggtctgaggcaagccagaagtgaggagacggatgcggatagatggggctcgctgagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccgacacatctgtcgcttcctcccagtgatgtgactattctctcagtacaactgtttgcatggtactgccacacaaagttgatttataaatctactattgaacaaaatgccttaatagcaattaaactgaatcctaaaatgaaaaagagtttgcaaaaaaactatttgtcatattctaaatgatgcaaatactaagcaataaaattactaatttttttaaagaaattacaaaatgttctaagttgagagatgtttttactgatcccagtgccttgaaagactactattacatctgtcacacttccacaacaagagaagttttagcagcatgtaaatcatttacacaaggatacaactaagaatagtaagccaaacagagaatgaagaaatccctctatttttaaatatgccttggagctgaaaagatcacgggtatgtgttatagaaggcattccttctgtcagtggccaaaatgctacaatcaaaatgttacaatactatgtcatcaaaaagaaatatcctacattaaaaaggatctactccgtctcagcacgaatacattctaagaggaaaagagggcatctggtcagagtatcccccatcctggggcaagttctccgaagtaccaggagaccaagaaccgtgcatacactctgggggtaaatggattgttttgtcactaaatcatgctgaggtaaaggcagctttacacttcctgacatagtaacaaacatatttctaagacaggaaactgtatcaacatccttaaggaaagttcttaggtcttttgtttttatttttttagagacagggtctccctctgtcacccaggctggagtgcagtggtgcaatcacagctcactgcagcctcgacctgctgggctcaagcaatcctcccccatcagccacctgagtagctgagacagcaggcacacaccaccatgcctgttcttttttgctttgtagatatggggtcttgaactgggctcaagaaatcctcccgccttggcctcccaaagtgctgggatttataggtgtgagccactacatccggccaagtcttttcttttcttttttttgagacagagtttcgctcttgttgcccaggctggagtgcaatggcactatctcggctcaatgcaacctccgcctcccgggttcaagcgattctcctgtctcagcctcctgagtagctgggattacaggcgtgcaccaccacacccagctaatttttgtatttttagtagagacggggtttcatcatattggtcaggctggtctcgaactcctgacctcaggtgatccgcccgcctcagcctcccaaagtgctgggattacagacatgagccaccgcacctggcccaagtctgttcttaaaacagactgacaaggtggtaacaacctgccaaaaggtctaacctgcaagattaacataccaagagcagccacgtgtcacttgcgtacaaatacaggagttggatattttcatagaaattcaagctttctgattgctaagcctactcttattcaaaatataggcctgcaataattaatctgaattgctaattaatagttattcattcagaagctgtgtcatcaaaaggcaaaggtggttttttgaaaactgataaaggaagggactaaagttttttggtattaccatctgtaaaggagtttaaaaaaaaaaattctgggccgggtgcagtggctcaagcctgtaatcccaacaccttgggaggccaaggcgggcagatcacttgaggccagagttcgagaccagcttgggcaacatggcgaaaccccatctctacgaaaaatacaaaaattagccaagcatggtggtgcatgcctgtaattccagctactcagaaggctgaggcacaagaatagcttgaacccgggaggcagaggctgcagtgagcagagatcgcactactgcactatagccagcctgagtaacagagtgaggctgactcaaaaaaaaaaaaatcattctgatatagatgttttgctgaattgtacatagagtttagtatgaggatgagttagatttccaatttcagatttccagtttcacactatgattagaaaagacttgctgtgactttgcatctttcttctgaggaggtaatttaacataaacacttctacctaatattacctgtcccttaaacatcatcattcactcacattcctctctcaaacctgctgttgatttatgataaaacacaagaggatcatttcaacagaaaatggtttccaggctgatgtagtgtctccaagggaaaagcaggtacttggctggtcgcacacaggagtaagaactggagtccctgagtgggcttcaggaggggcaaaaagccgctgagaatgatgtttgctatagatgaagtttgtggcgctaacagggaaggtaaagaacctttaaccaaacgacactgttgctgaataccagtggtcagatattttttcttcctcaagaaggagaacccatcgctgtggcccactgccagtggtcactcttcatcataaacaccctcaaaaccctttcaatcccctctcgccttctatcaccttaccttcaaagccaagatcttaggaggaatgtcaccgtctaagttgtgtctaccactcctgtctctcacccactgcaatctggcttttgctcctatcagtcctgggaaatactcttgctaaggtcacaactgacccctcgctttgttaccttactacacttcacttgagtcagcctccctgcctctatctccaccccacactgtcctctggttttcctcccatccctctgaccactccgcgtcctagattccttcctgtttctgatatattgagggaatcgagagtttcatcactgtccctgcctggaactcaggtaaacttaatgcaaagtactgtaatcataactattggtacgatatacttcaaaatcagtagatccttatgacctcaaggtgagaacattcaaaatgaccttgcttgactaggggcaagataaagagtgcttcttctagactcacctacgtctcagtgcctcccacctccaggtgtacgctcatcttgtacctaaggctcacacacaatgtgatcatgcaatcttgcatgctgtgttagggctcctcgaagacgtgtatctcacgctcatctgaacaacctctccatagaaaatgtcttagccatcatgatcacttgcactcagttttgatgaatggatggatactcaaattttatgcaggcagtactagctgcttgcctaccagacacaatgcattgagctggccacagaagggaacagaatgtggagacacagagcatgtttgtgcctgcccaaggatgctcccatccttagagacagggcctaactataagtgggcctgggggtgggctgggggtttaatggggtaatgtaaaagttctaagactacattatggtgatgattacacaactcagtaaatctactaaaaataattcaattgcatactttaaatgggtgagttttacagaatgtaaattatactttaataaagtttttttttttaatgaacagaacacagtaccagaagtttacagtttagtggagaaaacatgtacacaaatttgagtaattctgacaatcatgtcactcattataatatattgttctcatactaaatagggaaaccatttttttttttttctgagacagagtttcactctgctgcctaggctggagtgtggtggcacaatctcggctcactacaagctctgcctcccaggttaacgccattctcctgcctcagcctcccgagtagctgggactacaggcgtgtgccaccacacctggctaattttttgtatttttagtagggacggggtttcaccgtgttagccaggatggtctcgatctcagggaaaccatattcttacagtctaatagagatcacttttttgtgttctttggctaaccctgtaaatagttactagctcagtaagctttttggagagggcaggaagctgtctaataaatacaactaaatagtaccagtggataaatgcaaatctgctcctgaattattcatgtatttctttgggtatctctattgcacgtctcctcctactcaactctgacagaatggctaaactgtaaatagcctggttcctcaaccctgactgctaaatgtattcacttgcccatcataacaactggctgagcactgccacctaatcactaaaccaatgcaaactcctggtcaactatgaagcatgtaactctccacacctttaggtgcactatgaacaatgctaattagaaaacattcatagcaatgcctacaataggtttctaaagatgtctgaatattatgttggactgaaagtcaaccacggagagaacaggaacttgttgaagcaaacaaactcccttaaagatttatactcaagggatatctactttatgtcttatataattttcttcttagactaccaagcgtcttatatttggatatttttaaaaaatcaatgtgcaccgggcacggtggctcatgcctgtaatcccagcactttgggaggccgaggcaggcagatcacctgaggtcacaagttcaagaccagcctgaccgacatggtgaaaccatgtctctactgaaaacacaaaattatccaggtgtgatggcgcatgcctgtaatcccagctactcgggaggctgaggcaggagaatcccttgaacccaggaggcggaggttgcggtgaccaagatcgcaccattgcacaccagcctgggcaacaagagggaaactctgtttcaaaaaaataataataaaaaaataaattaaaaatcaatgtaaaacagaatacataaaaattttacataaataatatatttataaaatataataatttagaaggtgtcttttgtttttttaaaattcttctttgttacaagctggccaggcatggtggctcacgcctgtaatcctagccctttgggaggccaaggcgggaggatcactttgagttcagaagctcgagactagcctgggcaacacagtgagacctcgtctctatttgaaaaaaaaaacaattggattaacaatccaactcctcaattcctacgtgaactgcttataatggggggggaatagatgagatttatggtaatttttattttttacataaaatatttttactttttaaattttatgcaatttataagatcctttgatcaaactgaatttccagtagtagctctctgaagcactttatatatgcatatgcaaatgatgaaaggtaggatttaaaaaccaatgaattctacttccttattctttcattaatcacagctaaaatgtgaaacaaattttctgagtaaaagcttactattcaatttgtgtggtttaaggaacacaagctaccaaaatgtaaagctactcatccgcatataacagattatcaatgatacaataaaaattttgtaatatttgaaaataaattaatctaaatggtatgctgctgttggcagaactgcacacaaaacagacacgcacagaagctagaaaggacatacagtattgacagttaccatacccaggggttgtggtgatgaatggatcccctaccacaactttttgagaaatatctacattttctaatttttgttacaataaacatttttcttaaggaagtatctctgagccttgactgtgattaaaaaatctgtgattaatctcaaaattgaattacctgactcaaaggtgggatggaacttgtctgagaagtggtttgagatataggaccattcatctgtaaaattgaaaacaaagacaacatcagtacaatgtttaaaaagaaacaacatattttcaaaccacagtaattaggcaaaactaaacccaccaagaaatgcacatttcacatgacaaattcatgaattcataagatattcagaatgtaggaggcttaaaatttttaaattctgaatgaacatcatagataaagttctttgtagattcaatggggaaaactaagaaaagctactttgctcaaagccactttggaactttaaatattactgcttgacataaaatgtttaaatgaacaaaagtagtcaaaaaaatgtatattaaaatcctaactctttaaatacatcctactatagtgactataatgttattaaactatttacaaatcactacatatccttgatttaaaaaataaatggatttgagtatctagagctataacaattttgtttttgttatcatctactacttatagtttcctctactaagctacctctacatttttcagactgatggggctcaggactttctccccaaaaaatatggcacattgacatttgaggaaacagcagaatcaggccatggaaactagaaagaattctccttgccccttctcccttgaagcaggccataaaacacagctgacattcccctgaagacccttccagaggggccctgctctgtaccaggagcagtaacacacagggatgtcaagaaaaacctgaacacaacagccttgctaagcttctccagtttattagctctaggtcacatcccttttgtccaatcatgcttctccacaactgtcaacatctgcattagacttcgcaaaaaaaaaatacagttttccctgtttctttggttcttcctttgtggaggctcccatgtcacatacaacttattactaaataaatgtgtatgcttttctcttgttcatctgtcttttgttgcaggggtctcagccatgatcctcagatgggtaagaaatcttttctcccctacgagactctaatatctgtatgcagatcctaagatgtgccagtgttcctgtttagaactccttactaactccaatatagagtcctttatcaaaaaaagcaatggactccccaccaccccattcgacagcacccaccagatgagcgctgtccttgccctcctggactctctgcgtctgcggttcagccacaaccttagcgtcctgatcagaagtcatgggctccactgggagaagtgtaatgctaacctcaggatgctgtaaaatggcaaagacattaaacaggtcatttgaagggcacagtatgattatttaaataaaattaaaatcctcaagttttccaggacacacgtttatccctctgaattcaaaaaagtttaaagaagtcttcccatatgcataccttactcaccaagaagtgatacttaattttttaaataagtaagtttcttcttcacaccattttggtgaagatggccacactctaaaacttggaaactcatgtgctgacacaaataaacccatttgtgcctggaaactcaagtcttttaaaaaacagaaaattgaaggcttaatatccaagatatataaggaactcacaccactcgatagcaaaataaataaataaataaataacctggttaaaaaatgatcaaaggcatgaacaggcatttttcccaagacaacagaaaaatggcaatagaaatacgaaaaggtgctcggcatcactaattattggggaaatgcagaacaaaaccacaatgatatttcacctcacaactgtcagaatgactattatcagtcagacaagagataacagggcgtggaagaaacagaacctttgcacactgttggtgggaatgtaaattggtgcggccattatgaaaacagtatggaagttgctcaaaaatttgaaaatagaactaccatattatcctttctgagtatttatccaaaggcaatgaaatcaccacctcataagaatatctgcactcccatgtggattgcagcattattcacaatagtcaagacatagaaaccacatagttgtccatcaatggacaaacggatatagaaattgggatgtgtgtatctgtctgtctatgctatggaattatgtattattcagcctttaaaaagaaggaaaccccgtcgtatgctataacatgggtgaacctgaaggatattatgccaagtgaaacacaccagcacaaaaacacaaatactgcatgatctcactcatatgtgaaagttactatcttaaaaagtcaaatacatagaaacagagaataaaatggtgactaccgccgggcacagtggctcaagcctataatcccagcagtttgggaggccaaagcaggcagatcacctgaggtcaggagttcgagacctgtctgaccaacatggagaaatccagtctctactaaaaatacaaaattagctgggtgtggtggtgcatgcctgtaatcccagctactataggctgaggcacaagaatcgcttgaacccgggaagcaggggttgcagtgagctgagatagtgccattgcactccagactgggcaacaagagtgaaactccacctcactcacacacacacacacacacaaaatggtgactaccagggggctagcaggtagggaggaaatgaagagatcaatgtcaaagggtaccaagttacagatattttggatgagtaagtctagagatctgatgtacaacatgaggcctatagttgtaatattgtattgtacactcgaaacttgctgagagtatattttaggtgctcttactaacacaaaagaagggtaaaactatatgaaatgatggctatattaatgggctggactccagtaaccatttcactatgtatatcaaaacatcatgctatataccttatgtatacacaattaaaaaaaaaaaaaaggtcagatgtggtggctcatacctataaatcccagcactttgggaggccgaggcggatggatcacctgaggtaaggcgttcgagaccagcctggccaacatggtgaaacctcatctctctaaaaaatttaaaaactagccaggaacggtggcgggcacctgtagtcccagctacttgggaggctgaggcaggagaatcacttcaacctgggaggcagaggttgcagtgagccaagatcatgccactgcactacagcctgggcaacagagtgagactccatcaaaacaataaaaaatacaaaataacagaaaactggcagggtgcagtggctcacacctataattccagcactctgggaggccgaggagggcagatcacttgaggccaggagttcgagaccagcctggccaacactgtgaaaccccaatctactaaaaatacaaaaattagccaggcatggtggcacatgcctgtataatcccagctactcaggaggctgagacactagaatcgcgtgaaccaggaggtggaggttgcagttagctgagatctcgccactgcactcccacctcggcgacagagcaaaactctgtcttaaaaacaaataacaggccaggtgcagtggctcacgcctgtaataccagcactttgggaggccaaggcaggtggatcacctgaggccaggagttcgagaccagcctggccaacatggcgaaaccccatctctactgaaaatacaaaaatgagctgggcctggtggcacatgcctggagtcccagctattcaggaggctgagacactagaattgtttgaacttgagagagacagaggttgcagtgagctgagatcacaccacggcactccagcctgggtgacagagcaagactgtctcaaaaacaaacaaacaaacaaaaaaaaaaaaacacacacacacacacaaacaaaaacccagaaaattacaaagttaataggactccagaaataaaaacagttgttgatgaatgctaaattcagatatatttaagtgtcctcacttaacatcatcaacaggttcttggaaactgacttcaagcgaaaggacgtgaagcaaaatcaattgtaccacaggcacaaacaagtgttaagctcctacagcatatttccagtcacaaaaatatcaccaaacttctaattaaagacccaaaactccttctaatatttaaaatggcaataaatatgagccacacacatttttaaaagattaacaagaaagacaattacgtacctaattttgggtgagtcagaaagtgacagtggtcatagtggtggtataaccaccactggatttaaccaatcaaggaataaatgtttgcaaagtgaaaactgtaagaatattacggcagggcgcagtggctcgcgcctataatcccgcactttgggaggctaaggcaagcagaatgcttgagcccaagagttggagaccagcatggacaacatggcgacactcatctctacacaaaatacaaaaattagccgggtgtggtggcacgtgcctgtagtcccagctccttcggaggctgggataggaggaccacctgagcccaggaggtggaggtttcagtaagccgagatcgcaccactgcactccatcctagggaacagaataagatcctgtctcaaaaaataaaaacaaaaataaaaaaagaatattcctaccaccaagtagttaaaaaacaaactatgataaccaatagggcaggctcactgagcactatttgttgtgcatttatattattatagtagactttatgaatttttgtttcacaacaatttatattgattcattcatttctcaacctgcttattccagttcagggtaacaggtggccacagcctatcccagcagctcaaggagcaaggtgggaaccatccccgagaggacaccatcccatcacagggccgctcacacacacacccacactcactcactcagactgggaccaggaagacatgcaaatccaccgaacatgcacacctttgggatgtgggaagaaactggaatacccgtaagaaaacacgcagacatggagagaacgtgccaactccacacagacagtggtcctggccaggaactgacttctttctcatcatgttgaaatgacattgaaagaaatgatgtttttcaaagtggttcttcatgaagcatttactcaatccaatgtctagacactaaacttcacatgtaacatctcactcaattttcccaaacaacgtaagaagtaactggctcaccaacactttgggaggctgaggcgggcggatcacctgaggtcaggagttcaagaccagaccggccaaagtggtgaaaccccatctctactaaaaattagccaggtgtggtggcgggtgcctgtaatcccagctactcaggaggctgaggcaggagaatcacttgaacccatgaggcagaggttgcagtgagccgagatcgcccctaaacatactctagcctaagcgacagagtgaaactctctcaaaaggatcagaagggataactgtaacaatcccgtatcctgaggattcctagacatccaggtctgacttcaaggcatttctttttactgcaagctacactgcttcccaaacaagataaatattgttatttaacccaggtatctttttaggtacatctgaaaacatacatcagactgtcagaaaaaatacctttaaaagtgtaactatttttgtcttactaggtagccatacaggtttttcatggtatagtggagctccctattcgcaataatctgcttgtgataaattctcaaaaaccttgttaatgaaataatctgatgatcaaaggcaatctcatccaattgtgtaaactgtatcatcaatcacaaaaacatctaaatgctatcaaaaagagctggaaataaatgtaagctagcagagaaaaaatgcttgaaataaatacgggatgtatgacaaatgttacactttaacagatatatttcattttaatgtatatgtatcttctttttatgtctgtgtagtaccaacgtcttcttattaaacaaagaaaagagtgaatcaatttaaataaatatattaagtactagtataaatgctatcgggactcaaaaagatcttgaaaacagaatgtgagtaactaacttgtagaagacacagatttcgggaacatctggactgagattctaggtccttggttctcaggcctcggatgcaatgaagaatccctggagcaaattgtgattttgcaattttgtagtttggacttttttattattattattattatttttaactatgtagatgattctgaaaaacctgagcaaatacttccaggtgatgttgaagtaacacacgaggggagtagctcccactccctgagggggttttctacgagagaacagatggattccattgtaaaagaaacctacatgtcattaaacatcaattcccacacaaccacgaaatccagaaactaaagacatattaatagtttagcaatcaaatgggcaagtcatagaaggcgctgtggatgcttttgccaacattaatttccagatttttaagattcttatgatagccaaagggaaaaataaaaatcaactaaaataacactttatttaatacctgtatttttttagacaattggaatttatatacctcctgacggaaataccaacaataccatatatgaagtggtcttgcaaaaaaaaaaaagataacaaaaaccaacatgtgatcatgaccctaaatcttattacgaactaaccgcaaatacaagagccaggggaccaccaagggattccacacagtggaaagtttcggaactggcttcttcaacacaaaaggagacgtaagacacacgctggtcagtcagactatggctttacttggataaaggaaacaaaccaactactaaaaaagaaaaacgataatcagagaaacaacagtaaaaggacaactgataatactaaaaaatgattctagtttctcagatgtgataacgatgtggttatgtttaataaaaaggaaaccctatcttttagagatgtatattgaaatatttacagggaaaataatacaatgtgtgaaatcttcctcaaagtactatgtggggcagagaccctgaggttcatcgttattcttccacctgagagaaggaagttcactatactattctgtctacctttgtacatttgaaattttctataataaaaggttaaaaaagtaaccatgccacagtctcagcacaacacagtgatcccgatttgaacactctgcatcctacctattaaaaaaagtaacctttacaccaatatatctcttaattactaatctgacagtttttcaaaaaaggcttataaagttttccaacagaagggattactgatagtcacctcatttaaacagttaataacgtatcattttaatgcttttttaacttacctaatgtgtgaatctaaaatgagatttaaagaatgatacaagtattgacagctgtttcaataaataacaaatattttgttactggttcaagagacctaaaatattttgagatttaaaatatatcaactattgcctcccggcatggcctaaaagcagatctctagattgtaaagggaaatattcaatgggagaaaagaatcctccagccaaagcaaagtacttccacacagccgaccaaggagttgaaggcgggctccgcactcgccagtgccttacaccactcgcaggccttactgaattggacaggaggattttatttaatgtctctttatgtaaaaagcagagaggataagtccaagtgttctcccttcctatctgtggcctctatgctagtaacacatttttaacctcatctgtcaaagctacagtctaaaaaagaagttttatcaaccttgttcaacacttgggagaccataactctcttaaatcagtttctaaaaatttcttttcatgtacaccagaaatgtttattgcatgattaaacagttattatggtctttctagacacacaagacaatcttaaaaatacaacaccatctcaaataaacaactatatgtcaggttggtgacataatgatttagagaaaaattatcgttaatttttttttttttgagatagagtatcgctctgttgcgcaggctggagtgcagtggcgcgatctcagctcactgcaagctccacctcccaggttcatgccattctcctgcctcagcctcccgagtagctgggactacaggcgccggccaccacacccagctaattttttgtattgttagtagagacggggtttcaccgtgttagccaggatggtctcgatctcctgaccttgtgatccacccacctcggcctcccaaagtgctgggattacaggcgtgagccaccgcgcccggcaaaattattgttaatttaaaggacagctatttacgcagaaaaccctacaaattcaccaagagaaatttttttttttttttttttttttttaaatacagagtcttgctctgtcacccaggctggagtgcaatggcacaatctcagctcactgcaacctctgcctcccgggctcaggcaattctcatgcctcagcctcctgaatagctgggattacaggtgtgcaacaccatacccttttttttcttttttttttcccagtagagacgggattttgtcatgttggtcaggctggtcttgaagtcctgacctcatgtgatccacccccctcggcctcccaaagtgctgggattacaggagtgagccactactgtgcctggccacaccaagaaatcttaaaatgtactcagtaggcttgttctttgaggtaaatgttggtattattattttgaagctattttattttacatattgtatatatacatgcctacacatattcacactgaacaggataaagttgataagaatttccttaatgttaggtacacagattttcaacataaaaggagatatgaatacaaaattaaagaagctaagtaaactccacgtggtcattttttaaaattggaagtgtaactttttaaactacagtacaggcttcctttgcaatacaccactattaccactgatatccttttcctattctgggctctgatcttggacctcatgctgtacttagctgtccttccgttgagtctcctttaaactgcagcagttcctcagtcttgccttattcatctacgcttttccagagcactagttaattactttgtagaatgttcctcaatttgagatgagcctgggacatcttaccatgaagcaggaagccatgaagacaactggtcccatcaggaagacacagaggccacagcaaactaagggagggattcccaatagccatgcacggagccacatcaggatcaggaagaatgaacggaaaacaagtcggcagcaatcatgagagctaccaccaccacagtgctcgccttgggactacaggacacccacttattattcccaagatcactaaaggacaacagttatttcaagctgctgttcctcgatgaactgcatttctgaataaccaaaaagctgatcagggcaagaaccacagtcaatggggagtgaatgacaggatcggaaaaatcaaaatatcccaatatctaatacaataataaagtcaataatcattgatgtctgctgaaattatcaagtgaagaacgtgatgggaggtttccaaatggttaagtgagacattgactgaagctatttttcagtattatcattaaaactgggcctctaggcattttatttttgacatgatcaaagactaccatccacaaagtagtcgtgccaaaaaaagagcctgtatttaatcatacctctagatcttactcccaatttaaagggaattctagggaaatacatgttaaatcacaccagcacaaagccatcatctaaatccaaaatgtaggcaagaaagacgacctcatttctatagcaaataaaagatatttaaaaggagagctatttttattgccacagaattaaaaagccttaaccaaaataatccaatgtgatgtaagaactgtgtttggatcctgagtcaaataaattaggtttaaaatgacatagaaaaacttttaaggttgcctaggtaataaagacagagaaaactttttgacatagaaaaacttttaaggttgcctaggtaataaagacatgataaaattactattaattttattgagttccaaccatagtattgttatatttattttaaaagatcttctttataacagctagaaactaaaagactcatgaataaagatatatgtctggaatttgctttagaatatgccaatttttttggtaagtttaagggaagagaagaaacaaaaatatatgaatggtggcaagctgatggtagctaaagctagatgactggtgaactgaggatcactatagtatcctctctacttctatgtgtttaaaactgtccacaataagccaggcacggtggctcacatctgtaatcccagcactttgggaggccaaggcgggcggactgcctgagctcaggagtttgcgaccagcctcgggcaacacagtgaaaccctgtctctactaaaatacaaaaaattagctgcgcatggcggcgtgtgcctgtagtcccagctactcgagaggctaaggcaggagaactgcctgaatccgggaggcagaggttgcagtgagccaagatcgcgccactccactccagcctgggcaacagagtgagactcagtctcaaaaaataaaataaaataacgtaaaataaaataaaataaaaaataaataaaattgtccacaataataagtaaaagaaaacctaacttggatatattatcagtacacacttaagacttcatatgcttatttctatttaaaatttgtattaatgaaataatactaaatgtgtaaacaaatttattaacaatgttcacagcagcttagaaaaaaaaaaatcccatggaaataaaaacgcagaaagtaggctcatgcctgtaatcccaacactttgggagacaaggtagggagatcacatgaagtcagttcaagtccaacctgcctaaccaggctggtgaaaccatgtgtctactaaaataaatacaaaaattcccagctactcgggaggctgaagcatgagaatcacttgaatccaggaggtggagattgcagtgagctgaaagcgcaccactatactccagcctgggcaacagagcaagagtccatctcaaaaaaaaaaaaaaagaaaagaaaagtagaaacgaatgcagtatgttacaattacttaaaatactcacaaaaactgcataaagatttaaaaaaaagacaaaactgtagatactaaagttgcaatatatttataaaaattcaaattttataagtacgtaaaaacaagaaactagaagaaaatatgccaaaagactaacaatgtgtgattaacttattgacttcatctcccagagtctcagttttttaaataacatattatttttattacacgtcttcataaaacatccagcttgctgattccatcagttgctgagtccaaggtcccctgccatctttcccacagaaagggcactgctgcccacgcaggagaagctgcccatgcaggagaagcatctaagtcactttgcagttgtttttcaatacagattaatcaagtgcaattcagtgagcaaattttcttgtgaaactacactgctcagtcctgttcactaagataatggttctcaatgtgtggtgtaggcatagtccagagtcccagaaacacttccagtggggccacaaagtcaaaccattctcaaaataatgcaaagatgttctttgcttttttcactcttattctctcctcacaaaaccacagtggagttttggtatagcatcaaagaatattcaatattcatttatatgaaatgactaccaaaataataaaataaattacctgaggccagatttccttcacacacttcaaccaaaataacacagtactaagagatgaaatgcaaaagcagacaagaatccagccaagattctattaagtcagacattaaagagatttacaaaacatgaaaaaacaatgccactcttcccactgaattattttttgttttggaaaatactactacctttcataaacaatgttatttatattacctaatgggtttgttattattaaaaatgtatatttataatattaattgattcttgatacttaacatagtaaatacagacagagataaaccacagatggagacaaaccatataataaactcaagcttttaggcatcttcagtaatgtttaacagcataaagacgtccttagaccaaaagcttgagaaccactccactaatacaaacccttaaaacccagttctcaaggacagatgcccatgttcatggatggaaagacatccatgtttatgaagaggaagacatcccatgtttacagatgggaagacatggtatttttacaatgccaacaaaccccaaattaagctacagattcaatataatccctatcaaaattcacttttgtgggagaattttttttttttttttttttggcagaaattgctgagctgatcctaaaattcctatggaaatgcaagggacccagaatagccaaagcaatcttgagaaagaataaaattgaaagacacacacacttcctaatttcaaatcttactacaaagctacagtaatcaagccagcatggtactggcatagaccagacaaacagatcaatacaatagaaacgagagtccagaaagaaaccgttacatttatagacaactgattttccacaaaggtgtcaagaccagttgaggggaaaagaacaatcttgtcaacaaatggtgctgggacaactaaatgtcaacatgaaaataatgaagctgggctcctacctcaacatacacaaaaattaaggcaaaatgaaccaaagaactaaatgtaaaagctaaaactatatgacttggaagaaaacagcagtaaatcttcataaacttgtattaggcaatggtttattaattatgacactaaaagtataaacaggaagaaaaaaatacactggatttcatcaaaacgaaaaacttttgcccctcaaagcacactatcaagaaagtgaaaagataacccaaagaatgcgaaaaaacatttgcaaatcatatatccaatacggaacatatatctagaatatataaacaattcctaaaacttataatgagacaaataacccaacttaaaaattggcaaatgagagcccagcgcagtggctcacatctgtaatcccagcactttccgaggccgaagcaggcagattatttgaggtcaggagttcgagaccagcctggccaacatggtgagaccctgtctctacttaaaatgcaaaagttaggcaggcatggtagtgggcgcctataatctcagttacttgggaggctgaggcaagagaatcacttgaacctgggaggcggaggttgcagtgagccaagatcacgccactgcactccagcctgggcgacaaagcgaggctccatctcaaaaaaaaaaaaaaaaaaaaaaaaaaatggcaaatgatccgaacgaacattttcccaaagaagatatacaaatggccaccaagcacatgaaaagatcgtccacatcattcgtcatgagggaaatacaaatcaaaacacaaaataccactttgaaatgaaattaaataaaatgaagtaaatacagaaaattaaaacaaaaatactactttgcatccacttggatgactattatcagaaagataggtaatatcaagtgtggctagtacatacagaaactacaatcttcacacactgctggtacaaatgtaaaacagagcagccattataggaagcagtctggcagtttctcaatatgttaaacaccgagttaccatatgatctagtcattctactcctagggatatatcccagataactgaaaacatgtatctgcctgaaaacctgtatgtgaattttcaaagcaacattattcgtaatagccaagaagtagaaacaacccaaataataaactactaggttaagaccctcccttttttatgtgtgtctggcataactcattggattttcaaataatagcaaaaatcataatttcagaacttgataatttctaagaaaatcaaaataaagaggcatttcctaaacagcaggtaattcttttctggtacgaaagggtaatgtgaaaacacaaattatttgtctctgaatcagaaacctggaaagaaaaagaatgagtttggtaaggattattctaagtgctttctccacgttaccaaataaacttaattctgttaattaggttccatgcctatttagcacagcaggaaattaagatcagggataatttaaggtcacaaagctactaagttcagtgaggctatattaatgcacatataattttgctattcaactatatgtgcctggagatcatttaacaggcaattcactctatcaatccctgcatgtgggtgaatgtcacatcgtaacatgacctcagagaagtgcacctacagtttccttagctcgtcttcattccttcttcccttttacagtaatattcactgcaccaatgtacagatcatgattttagcatgtaaagataagcatcttttttcttacaatatggtacttaaatataagctaaatatttctctttttatacaacaaaaacagtgatttgattcaatgccagactaaaactggtattggatcaattgtatcagtgataatattaaatacattgtaccttacacggggatcttcaagtatattgatgatttttgcattatgggttgaccttagaacagacatttcccatgagagtgtgctgtatgggagccaaatataaaacctctctcctgaatctaaaaacattattctgaagtcaggaactccctactcacaacagattactccctgttctatttgccatgttctgcacattctattgccttttcctggaacacaggtatccctgtgttttatcttctatctacacacagtgatactgagaacaggacagaaatacatatcccaccaatgatatattacaacttaccttgatcttcttccttttgttagtaacattcaaatatatgcagttttactacagtgttgtctaagtactccatttctttatttgtaaagtttgctaagttaccttctaactctaattgtctatgattaggaacaatgagttaagggatgacgcatgaacagagatggacagcacaagatgctcctagacagacatgtgttccaagaactccaacataattttattttacagaccattttacaaaaatcagtaaatgaatattcaactagataagtaaacagaaatttacctaaataaggaaaaagggctaagaactttagagattgccttaattaagtactatataatctccttgggaatcaattagaaaaaatcaaaatgtgttactttcaatgtccaaacaaaatttgtagaaaacagtttaccacccagactttgatccctttgaagctacataaattgatcagaaaaaaaaaaaaatgatcacagaagctaaatcaaatcatcagaagcacaatcatggccaggcacagtggctcacgcctataatcccaccactttgggaggccgaggcgggtggatcatctgaggtcaggagtttgagacaagcctggccaacatgatgaaaccccgtctctcctaaaaaatacaaaacttagccaggaatggtggcatgcgcctgtaatctcagctactggggaggctgaggcaggagaattgcttgaacctgggagaagaaggttgcagtgagccaagatcgcaccattgcactccagcctggcaacaagaacaaaactccatctcaaaaaataaaaataaaaaaatgataataataaaaagcacagtcatagcattctaggatcggaaagaaggatgtctttttttttttttttttttttttttttttttttgaggtagggtctcactttttcacccatgctggagtgcagtggcccgatctcaattcattgcagcctcgaccttctgggtccaagtgatcctcctgcttcagctccccaggtagctggaactacaggagcatgccacaaagcccagctaaaaaaggatatatttcctttttttttttttttttgtgagaagcagtctcactctgttgcccaggctggagtgcagtggcacaatctcagctcactgtaacccctgcctcccgagttcaagcgattctcctgcctcagcctctcgagtagctgggactacaggtgcacgccaccacgcttggctaatttttgtatgtttagagagacgatgtttcaccacactggccaggctggtctcgaactcctgacctcatgatctgcctgcctcagcctcccaaagtgctgggattacaggtgtgagccaccagcgcctggcctctttttttttttttttttgagacggagtcttgctctttttgcccaggctggagtgcaatggcacaatctcggctaactgcaacctctgcctcctgggttcaagcgattctcctgcttcagcctcatgagtagctgggattacaggcacctgccaccacgcccggctaattttttgtattgttagtagagacgaggtttcaccatgttggcctggtttcgaactcctgacctcctgatccacccgcctcggcctcccaaagtgctgggattacaggagtgagccaccgcacccagcagaaggatatatttcttaacagaaattttcattatgattcccacgtgcatatctaaatagagaagtgcagaaaataaaatacaataggaattctagttcctcatccatctgccttgtgctgttagttggatgatatggtttatctcacggctgccagcaccactctgtaatatttgaaatgcacatttttatcttacaatagaataatgtgagagcaccttagggcagattattttatgttccttccatgtaccttatacacatcatatactcaagtgaatctgtaagcttgaatagtgggaacatttacagagcaacagactgctgcttccaacaaaactgttattttagtcttttgtttttttcaagattcagtatctctatgatattccattcttttcgtttcatgttcttatagtaagtgtgtcactcaaagatactgacggataaaagaaatgcgtccaatctcagtagagtagttgtttatacatttaaactggcactcagcactggagtattcctaaggagatgttgccaataaatttcaagactaattttgtaaaatgtcctttatatgtgtacatcggtgcttctactgaaaaaaacagcagtgagaaaatgtgagttttatttatagtttgagttggttctcctcctaaggaggacataatcagacacaagatacaaaaacttatttgttagcaagatctgattgaaaaagtacctacatgagaagaccaccaaataatatactttcaaaatcttcctgattttaaatttagaacgtgtctactaagtcgacacacaaaaaaaggacaacggtcccctccaccgttaaagcctgtgactgggtctacgacattatcttctggagagtacaatcttttgaaaagaccattttagctaggattcttactaaaacataatacaaaacaaccaccgaaactggagtttagatcatctcattaaccctctggctaggagagcattttactcattaaacctttgacgaactcaaaaaccaccactctaatacttggttgtaaagaagctgaaataaagtatctgaaccaaatgcacagaacattgttttgcacaagccctaagctgcagcagtgcgaatcatggccctcggagtaccacttcttgcttttatcccgtgctacacctttcccagtaaagagcttcttaggaagggtttccacaccttttcacacactttcacaaagggaaaagcaaatggaaaagttgacaactacattaggagtatctttttaggacacaagcttagctaattcacacagcttcctttgtcaaatactggactaccaagaagcatcaaaaccaaaatctgcagtctaagcagggcacagctgcagcacgttcacttcatttaacctcaagttgaagcagaaacataaaatcttttttttttttttttttaattttgagatagagtctcactctgttgcccaggctggagcgcaatggtgccatctcagctcactgcaacctccacatcccaggttcaagtgattctcctgcctcagtctcccaagtacctaggattgcaggtgtgcaccaccacactcagctagtttttgtatttttagtagagacagggtttcaccatattggccaggctggtctcaacctgacctcaagtgatcccgcccacctcggcctcgaaaagtgctgggattaccggtgtgagccacggtgcctggcataaaatctttttaatacagatgttaaattacctggttgaaaagctagttgtctcttttgtctagtctgtttagaatatattctaacctccatttttctgtccatcagcattttattccattagaaattacttctcatgttgagaatgtcaacctggacaaacaagattcaacctaacctggcaggatgtgtgctggatgcccaggaagcctctcctgacttgcaagcgtcccctacttccactcttccacatccttcagacccacctgctcactgctgcactcaggctcacttatgccatctctcagccatggactgatctcgcagatggcaaacaaagtatacccagagtccagaggaggaaaaggcaacttcctgttgatgtttcacatgcaatcttaccttttggacaaagagcagaactgcctgattcaatcttttataatttacttttaccttaaggaattgcatatataaacttatcttactgcacggctttaattccattttgaatatgtattttcttgagattattgatagtctccataaaaatctttgcttcctctcatttacatctgaaaacaaaacaaaacaaaaatgctgatggacaaacgtagtagcatgggcatacacctgaactgaggaaaagccagaattggcagcacagcacacagggccttcctcgtcaggaatgcaccttgtagagtacaccgcttcactctgatgggtggaaaaggtctctctccacctcatttccagtggatcctgcatttcttcaaggaatacagatcatgttctattgagctttccaattcatcatcacaaaactacagttttcaattgaaaatacataatactcaaagagtaagatggggaagtggtgagtaaactcattttttagaatggcaaaatgtcagagctgggaagcagctcggagctgctttaatcctgtgcggctcaaatgggaaggcatatttgtccctaacaatgagtcagagaaccatgaaatgatacataaattgattttgttaaaaaaaaaccttgacacgcaacactgacagaatacaagctgagcagcactaatctgaaaatctgaaatctgaaatcctccaaaatctaaaactttttgagcaccaacatgacatcacaagtgaaaaattctgatgtttcttctcacctacgaaaattaaacacaatccaagcacaatgatgcatacctgcagtcctagctacttaggaagctgaggctaaaggattacttgagctcaggagttcaaaaccaatatgggcagcatagcgacactctgtcccctaaaagataaataaaataggccgggtgcagtggctcacacctgtaatcccagcactttgggaggccaagaaagggagatcacttgagctcaggagtttgagaccagcctgggcaacacagtgaaaccctgtctctataaaaaatacaaaaattagtcaagtgtggtgacatgtgcctgtagtcccaggaacttgggaggctaaattaagaggctcacttgagcctggggggcggagggttgggggggcattaagccgagatcatgccactgcactccagcctgggcaacagaggaagactgtctcaaaataaaaataaaaataaaaataaaataaaaataaataaataaaatgaaataaaataaaaatacataaaacacagtgtacagtgaccttttaatcacaacacagcatcataggtggacactgaaaagtctgctgctgctgttatctgacggctgatccaggtactgtggcgatgtcactgggctggttagttacccgagcacatcatttcctcactgtattaatgctatgtcatgttctttactgctgagtactcccatgcgagcaagggtaagaagatgactgccacttggtagcatataaatccagaaccaggcacgatggtggcattaagcaaccagactgtccacatgggtggctgggatggtgacatctttgctttctgatggttcaatgtacagacctcatttcacgctaaatttatttaaaacattgtataaaagtaccttcaggctatgtgtataaggtgtatacaaaacaattctgtgtttagactcggatcccatccccaagatacctcattatgtatatgcaaatatcccaaactccaaaaataactgaaatataaaacacttctggcctcaagcatttcaaataagggatactcaatctatagttataaaaatgtcttcctcaagttattaatacagccctggaggcactccctaaagtcttattatctgaacctgcaaattaccttccttaataattaaatgccatttaacagtgttataagtggtgataaaatacaccttattttacacatgcattaatgtgaagtcctcctttcttgaatttaatattcctaatatatacgtatttcttagcatttcagtgaaagggaaatattccataacaattataatcctatatagctcttgaaaatcacacctcagaagtcaagacaaggaatctaaatagagcagacataaaacacttgaccgaagtcaggatcctatcttcattagtccctccatgcccagtctagatcccatttactcctgtctttgcaattatgtttttttccattatgttcaatccttccctgtcactgtttcaacagcttattctgtcgcaaaaaaaagaaagtgaacgtggggaggggaggagctgaggagcaagggaggagctgaggagcaagggaggagctgaggagcagggaaggagggcagaatcagcaggactggacgtcctcctggcctcctgctgaagaggcagctctcaactgtttctatctccaacctcccagaaaactttccttctacaagaaccagcctcctgcttgctggtggacagggaggacctctcacagcacagtggaacagaccagcctttcccttgaagcccactctaccctcttccacttcgtcacctgctttctcagcctcttgggaatgctcttctgcactaagtagggcaaaagctctcttgccctgtgcaatcaaaagaaatagtaaatcaaatgggcaatcataaagatgaatacataaatctttagctattttatacatcttcattcacacgggcctttttctgagacttggtcaattagatattatttctttcccacataaactatatccataatgcatcaacaaagatcttcattgttttttaaagtgcagctgagagacaggaaaaccctctgaatagtacaatgcttctatgactcttcttcagtttttatccttattttcatatctaattcatcagcagtttctctgtgatttgtttttgagatactccaaagttttcaaatgagtaactgcttttacactattttgatcaatttatattaattaaatcacacagctgcacgaatgagtatgatcgatgaacaagtttggaagctgacctggctttggtaagcacacaactccactggtgggaagagggaacagccctgctgaagagaagcccagcgccagtgtggtgcaacccacaggtatgcatggatccacagacagcgttgatcctggtgacaggccacggtatgtgtgcaaaggagtctacctccttgtctccttgagttatgctcctgtgctcccagtttctcatggcttctgttcacaaccatatgctcagtttcagcacaaaattatctaagtgaatgcccagtgaacaccttatgatcctgcagagttctcaaaatcaattccctacttctcatttaaaacaaatacgaactgataaccaatctctcttattgaaggacatatcattgactcaggtgcccaaggcagaaacttgcaaatacagctttaacttctgctcaagtttctatccctgtcatgaaactgtgcagaaaaccaccaactgaactgaattaccacccagtttcttaaagcatctcccttcttcccacctccccaaactccacagattcttccagactgccctccctaaagcgagggactcgcaactgaaaccttctgacaggctgcaccaggataaagtgaaaagaaccacagctactgagatgctctccccatcctcccacaaagccttggttggttattctatgtactcctgcaaacctttacacccaggaatacagcatatcaaattatcatcctcactccaacacaaaagttttatcactcggaggtcagaaatatgtctaccctgttcactgttgtatccctaacacagtacctaaacgagtaaaatctcagtaaatacattaataatttattatcttgtggcaacaaatgtgggaaaaattaactagcatttaaaatatgaagcccagaaaatgggatgagtccaaagaacggcctctgctggtgcacattccaagtggtgtaataagggaaaaggcaatattcacagctgagggcaaaattactttgagttaattttcattttcattttattttattctctagactttgtatatgcatacatgcatgtccgtttaagtgtgcacctgggatctaaacatacaaaggagttaaatacaaagtgatgactaaaaatttttattgtattatcaaaacaaatcactaaagaagttccgaagtggcaaacacatactgaaacaattatttgtattgggggatgtgagatcgtgaaatatatatatttggttttcctcccatttcatggcatagaattcttaaaatccctggaatctcccaagtaataaatgtctttttgtatactaatgatatgactgggctggcagtcctaaggtgttttcaggatgggaactagtcaccagaaagaccgaggcagaattagactgttgggactttcagcccactcccaatctccaggtaggggaaagtggcagaaggttgatcatcaatggccaatgatttcagcaatcatgcctatgtaacggagtttccacaaaaaccctaggctgggtgcggtggctcacgcctgtaatcctagcactttgggaggccgaggcaggtgcatcacctgaggttaggagttcaagaccagcctggccaacatggtgaaaccccatctctactaaaaatacaaaaattagctgggcctggtggcgggcacctgtaatcccagctacttgggaggctgaggcaggagaaatcacttgaacacgtgaggtggaggttgcagtgagcctgagccaagatcatgccactgcactccagcctgggtgacagagcaagactccgacccaacaacaacagaaaaaggactcggtttggggagcttccagatagctgaacacatggaggttgttaaagagtggcagcccaaagagggcatgggagccccttgcccttcccccacaccttgccccacacatctcgtcatctgcatcctttgtaatatccttcaaaataaaccaggaaacatgttttccttacttgtgtgagtctgtcaagcaaagtaatggaacccaaagagggggccatggggatcctaggaagcatgggtaaacaacctgtggcgtgggagtggcatcagaaggggcagtcttgtagggatgagccctcattctgtgggacctgacactatctccaggtagagtgttgagactgaaggggagggtgccccactggtgtctgctgtaaaactgattggttgctggtggggagaaatccccgcacatttcttggtgaccagcggtcacagaattcttctgggttgattgttgtgacgcgaaagcaggagaaaaaccgctttttcttcaggagggaaaggtcaaaaaatcctttccaaaatatactgaaagctatgaaacagaattcagaagttccaggactcctccaagttcatctacaaacaagaaaaggaaacgtcaaggagtgcaggctgcagcacggggggggcctcccttgccaggtggtgaggggccgacccacctctcctcctttgggggacacctgaaacagatagcacaatgcctggcacacagcatgtgttacacaccacagccaaacggcaggcgtgggagctatgaaattccaagttgcggccaggcgcggtggctcatgcctgtaatcccagcactttgggaggctgaggcgggcagatcacaaggtcaggagatcaagatcatcctggctaacacggtgaaaccccgtctctactaacaatacaaaaaattagccgggcatggtggtgggcacttgtagtcccagctactcgggaggctgaggcaggagaatggcgtgaacccgggaggtggagcttgcggtgagccgagatcgcgccactgcaatccagcctgggcgacagagcacgactccgtctcaaaaaaaaaaaaaaaaaaaggaaattccaagttgctcagagagtcaatgtcactgactccaagcacagaatccaacaacaatcttcaaatattaggcattacacctgcagaccagaattgtttcccagaaacaatgcaaactgtttaatattaaaatatagtgaatgtcccctaaaattgttacttacaaaagtactttttacaaaagagaccgggctctgtggctcatgcctgtaatcctggcactttggggggccaaggcaggtggatcacctgagggcacgagtttgagaccagcctggccaacatggtgaaacctcgtctctactaaaagtacaaaaatttggcaggcatggtggcaggagcctgtaatcccagctactcgggaggctgaggctggaaaatcacttcaacctgggaagcggaggttgcagtgagctgagatcgcgccactgcactccagcctgggtaacaagaataaaactccatctctaaaaaaaaaaagaatttaagttccaagattttttttttaatcttactttggtttactattccaaatgacaattacctaagacatagcagtaccatctccatcctataaacaaattggattacaattacaggccagttatggttatatgcctacttcaatagacaatgtgactgagaaaagaaaaacagcttagtgcagttgagctatgtgaggtatgcaggcccagagagccgtgagtgtgggacttctgtcatgcctcccgccccagatccatgctgagcagaattgtttagtcattttgttcctgactggctgccttacccttatcttcatgttcctgaaatctatgacaacgatgaacaatgtacagccaatcaatagcttatgttattttgatgtacattttttgtaaacaactcaggaactgccttttttccctttaaaaatctacttccaacttctgctaatggggtgtatactcagagcaacctgaatccatacacctgggctgcaatcctcaggcttggcccaaatcaactctctacttatattaattttgcctcagcttcttccttttaggctgacatacgtgatgtaagacagcaggattcagaatgtctcccctcaatcacctggtttttctgagagtggcgctgggaaccagtgtgacactctccatcttcagaggtctcatgtggtgttttgtgtgaggtctcctgaaattggaactcccattctttggctgaacatctagattttacttggactgtttttcaaactccctctttcctttaagagtgagggctttgctgtctttggacaagagactggggtgaagagttccgcagacaactgccttctttctgcctctgcctcagggccaggattttgggtcaaggtttttccacctctgctcatggcagaggtttgggataaaggactggcagatactggtggttacgttttatagagcatgcttttaagattgcagctgttttctatcatttgaaaatctgggcttagcctttcatttgtgaccaactcctgttagtttcctactgaaaagcacacagcccttttgctcctccagatgggtgtgagggtctggtcccccgtaccctgcttgagcactcccgtcccctggcagttagggacagtccaagtcacatcacacttagaccctaaacacattcccagccatttgtcacttttcagaagttagtaaattatacaaaattggactttacaatctgagcagtctttgtggaaacatcagctggatgtgtgtgcacttagggggcactctcttacatttagaaagtggagccgcctaacacaggacagttgtgagcagcagtagccaaaatgagcatcctttaagtgtctaaaataattaatctgtgtacctaattgggggaaaagttggctttagaaccagagaaactaaatgggaaacgtactttatgtttgtgctgaaatctgatgataagatttgaaaacattctttttcagagttctacggtcagaagtataaaaagctgatactttggctattgtttttttggaaggaaaaaaaaagcctttctgctttttcctcttttggatcctgtttctgggaactcttttcagtcaactgaaactcaccttaaaatgtgtttgatccctgtttgcttcctgtcttgttggtatgatttttgtggaggaaaatacaaaacttaatttgcctgtcagaaagcttaagatcttcctaaaatggttcctctgagacttgttctgtttccttccacacttctactccttctttttgccatatttgatacatgaagaaatctagaggacacttctaatgactctgagacccgcttcggaacacaggaagaggcaacactcacccccttctggaagggtcttctgttttcagtacggagtctgaagagttgtgagtagtttcctctcaggtctaaagctctgctcccttttgcattgcgctgtccaatttcgtggttttcgggggctttcgggattactttacactgtgagagagaccctgacttttgtgtgtgcaatggcggacaagtcactggtgaaagctgcagtttgggaagtggctgactgaatagttgttactgcaggatggctactgtttctttacacatttagacagatgcagtttgaacacttggaggttaggagagtgctcaccaccaagtgataagattcccatatgggatgggctggtcacagtgggctgactgggccactcaccaaccttgagggaatgtccttgcagtgagaagcactgtggaagctctgcgtggcaggtgttatggcgtttccctcctttgggggacccaagattcagtctattaataaaagtggaatccttgatttttaaagatgtagatcaagggtgtccaatctttggcttccctgggccacactgatcttgggccacacataaaatacactaacactaatgacagctgatgagatgcttaaaaaagagagagagaaaagaaaagaaaaaaaaatcgcaaaaaaaaaaaatcttcatactgttttaagaacatttacaaatttgtgttgggccgcattcaaagccatcccaggccgagggtaggacaggcttgatctagatgctctgcctttcatctgtgcctgcttttcaaatttaagtattaggccctagaaactgcaaatgttttctttttccactcattaaagtcagtaatctaaccaagaaacatctaggttggaagaccacctatctaaccagactgctctccaatatatgacgttctatggccgagcgcattggctcacacctgtaatctcagcactttgggaggctgaggcgggcagatcccttgagctcaagaggtcaaaaccagcctgggcaacatggagaaacctcgtcttgacaaaaaaaaaaaaaaaaaattcaaaaaaaaaaattagcggggcatggtggcgtgcgcctgtggtcccagctactcgggaggcatcacttgagcctgggaggcagaggttgcagaggtcactgcactccaacctgaatggcagtgagaccccatcaaaaacaaaaacacaaaatatgactttctgacatttagctagctatcctgaacctctttataaaagaaactgacatctgtaagggcatctcccttcctgcactcaagccactataaacttttacaatgaaaaaaacattggcttaaagtttacagagcaaaccttccctttgcttgatgcttttcctggcaattcctgactatccctttttgattcaacaaataatagtgtttagatctaagttctctgcctttgggatgtaagttttcacctgagagtcatgtctttggaagtgaaaatttagggttgtctagcaatctgaattgtttaggggagtggaacagataattaagagactgatagtctaaaggagggggggaattattttcactagcaaatgaaaaatcttataaaactgtaagatctgcttctgttagtgcatctgcatgtctttacttttatgtatcatatatatgtgatatttcactaccaaaatatatgaaacacctctaattaaccagcttaaagaaaacacaagtgcttaaatcaaatatttcatcagacaaatagaaactcaaatgtcttttagttcatgacttgggtagatctttggtaaataaagattagtttgttggtttaatgaaaggagctatgtcttctcatcagcaaatactcattcatttaactctagggtttcacaggctgtagaaatgattaacaaagaaataaattgagatgatggctaactttgtttaatgaactattcaagcataataactgttaagaatgaataaattagggccgggtgcagtggctcacgcctgtaatcccatcactaggagttcgagaccagccaggccaatacagtgaaaccccctctctaccaaaaatacaaaaattagctgagcatggcagcgcacgcctgtagtcccagctacttgggacgctgaggtgggagtatcacttaaacccaggaggctgacgttgcagtgagttgagatcaagccactgcactccagcctgggtgacacagtaaggctgggtctcaaaaaaaaataaaaataacgaagaataaattagatgaatgtaaataagatatttataaacaaacttttcatagtttcacaaacccttttcaaaaatttaatcttaaagccatgttatgttaattaacaggtaatcataaaatatctatctcatttatagggtacagaaaagttaaatatatttaggttataaacaaaatatatttaggttataaacaaaaattgaggaaatattcagaaattgttgtcatgtggtataaaacagttcaaaattacttcctgggtttttcactggaaattcgagttactaagagttaaaattgtagttaatatacgtaattaaaactattaggtataagaaacaattttatatacagagcatattttaaaagatgtaaggaaagttgaaaagagactaattgtttttcccttgtacacagagatctttgtatggtcaaaatgataagggggaaaggaaagtaagtttttctcttaaggtaaaatgccaatataaaaaagaaaggtaggttgcagtgagccgagatcacgccactgcactccagcctgggctacagaggaagactcagccaaaaaaaaaaaaaagtcgagtgaggcgtggtggctcgcacccgtaatcccagcactttgggaggccaaggtgggtggatcatgaggtcaggagttcaagaccaacctgaccaacatggtgaaaccccatctctactaaaaacacaaaaattagctgggcatggtggcgcatgcctgtaatcccagccactcgagaggctgaggcaagagaattgcttgaaccgagacccgggaggcggacgttgcagtgagccgagatcatgccactgcactccagcctgtgctacagaggtagactcagcgccccacccgcccccaccgcccaccccccagcaaagaaaaaaaaaaaaaagaggtataggtcaaaaccaaaggcttcagcaagttgtagaccatttgtggaagattaatcttgtgaaaaaaaaattgtgtgtaatcaagcttgctaaattagaagagaattatttagttttgctaaaattgaacattaatatacaacgtacacaaatgcagggccagagtctgggcccctgtgtcagaacagcagacttttcttggagcactggtctgctctttaagaaaaaattttaagtggttgtaaaaagtttatggaaattttatcttgcatggtccaagctgattgagatttgatggacagtttcattaaaatagctttatactcaggaggctgaggtgggaggatcacttgagcccaggagtttgaggctgcagcgagctatgattacaccactacactccaccccaggcaacagagcagaccctgtctccaggggaaaaaaaaataaaaggctctagcactgacaatatactgatgcaaaggtaaaatttatttttctcttttgaacaagatgttcatataatattaatgaggataacaaaagacttttgctcaccttttgaataagctggaaaaaaaaagattctgttggtctcatgtcgtctttttaggtcttttgattgtttagaaaactgagtatcaaaaaagagaaaaagtttttgtttttttggccgggtgcagtggctcacacctgtaatcccaacactttgggaggccaaggtgggtggatcacgaggtcaggagatcgagaccatcctggctaacacggtgaaaccccatctctactaaaaatacaaacaattagctggatgtggtggtgggcgcctgtagtcccagctactcaggaggctgaggcaagagaatagcgactcaggaggctgaggcaggagaatggcgtgaacccaggaggcggaggttgcagtgagcccagatggcgccactgcattccagcctgggagacagagcgagactccgcctcaaaaaaaaaaaaaaaaaaggtttttgctttttgaaatatttcaattatctggctaaatgactattattttacagcaacctgtgattctgttttgaacaacatccttttcaatatttgacacatttcccaaaatcaactttcaaattctaaaattaagtcttttccaaaaggaaccccctggaagtccgagagagacctattaggcttaattggtatgttaaaattgtatgtgaagctttgtcaaataagaaatggtgtttaactttgggttatatttgtgtgcatggtattaatgtgtgttccaacgttacatgagatttctgaaatcctgatatgtcttgatatgtcagacataattatggttattatgttaaattgttgtatgccacaaaaataaccaaatttccttgtaaattgtgtctttaactgtagctactctaagtcttttggcatccacagacaattattgttctactttgactcttctcaaaaagtagtttacacttggctacagtcaaaaatttgctttttcttcaagggaattcatggaaaataattttttttttaagagacaaggtcttggctgggcgcgatggctcatgcctgtaatcccatcactttgggaggccaaggcaggcagatcacctgaggtcaggagttcgagaccagcctgaccaacacggagaaaccccatctctactaaaaatacaaaactagccaggcgtggtggcgcatgcctgtaatcccagatacttgggaggccgtggcaggagaatcacttgaatctgtgaggtggaggttgcagtgagccgagatcacgccattgcactccagcctgggcaacaagagtgaaactccgtctcaaaacaaacaaataaataaagagacaaggtcttgctctgttgtgcagattagagtgcagtggcactttctaactcactacaacctcaaactcctggacctaagtgatcctcccacctcagcctcccaagtagctacaactataagcacacaccaccacacctggctaatttttctattttttgtcgagatgggggtcttgctatgttggccaggctggtcttgaactcatggcctcaagcgatcctcccttcttggcctcctaaagtgctgagattatagctatgagccactgcgccaggtggtaagtactcttgaatacaagtttctgataattttgaagaccattatcattggagtaagtaaaaactttcagaactctaataaactgttgtgttcatgatgattgctaactctgtatatcaagcagaataaaacttaattacatgggactgaaattacagatgactgaaatgattttgacgactttttgtttgaaacattgctgattcttttcatgttttgttttcccaagtcgaggaagcttttttctttcaagctttttatagcttgtagcaaatgggtaaaacataactttatgagcaagactgaaacattcaccttactctctaccttatttctccaaaatgtataaactattcatgagtactcttattttatgacagtctaattatatgcgttttaagttcaataaaaaccggtttattgtaacaggacacaattaagacactggttattctaccgacactcttgactggaatggcgtattttaagatatgaccagactggtttaaagaacagaggttgactatgtagagccaataaaaagcctgttggaaagactagcctggtaccttgtttacatggctcctttacaaggttcctgatgtgcagcaagtaaaacaatcttactttctgacaagcccaggaacctcaagatattttgcgacctcaagaagagaggaattcacccaattcatgtaagtattaccagcatagtccttggcttggcttcctagccttgaggctttatagttgaatccaaaattccttatgaaagttccagcaaagacaacttaaagaacctatatggccaatcattattcttgttgcattttatgcaaataatcagcccaagtataatactaaaacttattttgcaagtaagctggtcctcctaagatttatatcttcagtaaaaatggggactggagagagaaaaaattatgcttcataagaaaactatagtacccatgttattagattccagccttaaccattgtgtttgagtttttattgttttcctacaatttggattgaatctccaatgtaataggatttttactatgtattttattgttttacctctaagaaaaccaaaagcatgaaattcaaagactacagaagatttaacaagcaatgacagttacataaatcagtgacttgactgagggctgagaatgagccttcccagcaccgtcatacatcatcccatcataaaaatccacttgtaactgccgctgagcaacttggtctatgctcctgggttgcaatcatcatgcttggcccaaataaactcttcactcagcttcttcattttaggtcaacactaacatcacaaaaagagtttcagacaggccggggatgatggcacatgcctgtaatcccagtgcttttgaaggccaaggcaggaggattgcttgagcccaggagtttgagaccagcctgtgcaacaagatgaaaacccatctctacaaaaaaatacaaaaattaaccaggtgtggtggcacgtgcctgtagtcccagctactcgggaggctgaggagggaggaccgcttgagactgggaggtcaagaccacaataagccaagatcacgccactgcactccagcctggcaacagagtgagaccctgtctcaaaaaaaaaaaaaaaaaaaaaaaagtttcaggcaaactataagaatcagccattgaaaattcctatcacttccaatgattctgaattactgttcggaaatgtagataactttactcaatcttgtagcataggatatctctggcttcaaagataaccacaatgggccaggtgcggtggctcacgcctgtaatcccagcactttgggaggccgaggtgggtggatcacgaggtcaggagatcgcaaccatcctggctaacacggtgaaaccccatctctaataaaaaaaaatacaaaaaaattagctgggcgtggtggcgggcgcctgtagtcccagctactagggaggctgaggcaggagaatggcgtgaacccgagaggcggagtttgcagtgagcggagatcaagccactgcactccagcctgggcaactgagtgagactccgtctcaaaaaaaagataaccacaatgaaaattactattaatactttgtttaacagtaattattcaactattaaatatttaaataattaagttattaaactattaagtacagggcctgtatctctgatgctgaactatgatgtgtgacttaagcccccaaatacatcatgttatttggatccaaggtgctgcacagaacgctgaccctctctaagagctgggtattacttgcaaaaggcttataagcatcggtgcatgggtcgttcagtggtagaattctctcctgccacgcaaaaggcttataagcaagaagctataaagttcccattttctgttcttcctgtattggatgatgtaaagcaaactgtcaccaagactcagtttcccaaacagtaaaacaagtgttctgaagaataaatggggggaaaaaagggagggggctttcaatcctctgaattacaagtccaatacattgttgagggtgggagttgttgcaatttgctgtagtttcttaagagtgtaagatagtgtgaaagatcctgacacacaccacagttgcctgaggacagtaaaccaaaggccaggagagctcacagcaagtcacattatctctagtgtgagttcctctacacaaaggtgacgggtatgaacacaggtgttgaagttggatccaagactgcacacagactcctgtgttaacagcgtggacgttaaaatgaacaactctccctgaatgctttaggaagaaaaccatttaatttacatgaatttctcttagactatttctcaaagatgaactgtaagctgcagtctgattacacgatacaaaccggagggtgttaaccagaacaccaattagcacctccctatttggattaaggttaatggattatctaaaatgacaaaacacttaattttcctggagtaaatatatttcaatcttttaaaaagcacagtctaataactgctttaaaaatctacctcaaaaagttaaaacacttatttaaattatctaacatacataaaattaatgctttcaccaatttcttttgatataccacagcggagggtgcgccttaacagcgaccacagtaaactctgcaattacagtgcaacgggatgctggacttaaagaggaggctcgttacagtcctagctctgtcaccaactagccagctgtatctctaattaattttacctcatgggcttcagtttctgagtcttcagagatctaaaatcctaagactgcaactgcaatattacactgtttttctgacaattattttcacaaactagttaccaaatctcagttgacaaaataacgtagaacaaaactcacagtcttagaatataaacatcttacttcaaaagtactatttaattcacacctaacattttatgaattaagaattaatcaggccagacacagtggctcaggcctgtaatcccagcactttgggaggccaaggcaggcagatcacttgaggccaggagttgcagaccagcctggccaatatggagaaaccctgtctctactaaaactataaaaataagctgggcatggtgacgtgcctgtagtcctggctactctggaggttgaagcacgagaatcacttgaacccaggaggtgatgattgcagtgagccaagatacagccactgcacttcagcctgggggacaaagtgagactctgtctcaaaaaaaaggaattaaaaagaattaaaggttccttcagtcttttaattccagactgataacgatggaactgataaaaagaaaacactccatgcaactgggttaaggctgattaaatgttatgttcactattattattattaaacatttcgtaaatatatgctttacaataaatttacctaaccacacttcccaacatcaaattgaaaactggaagttaagggtcaggcatggtggctcacacctgtaatcccagcactttgggaggccaaggcaggcggatcacctgaggtggggagttcgagagcagcctgaccaacatggagaaaccctgtctctactaaaaatacaaaactagccaggcgtggtggtgcatgcctgtaatcccagctactcaggaggctggggcaggagaatcgcttgaacccaggaggtggaggttgcagtgagccgagatcgcaccattgcactccagcctgggcaacaagagtgaaactccatctcaaaaaaaaaaagaaaaagaaagaaagaaaactggaagttaatgatccagcatttatttgccttgctcatataattatctaacacaatttgtggccatataacgattttgggaaaacatctagtctacagttatttatgttgagctgtaacttcatgtgatttcatgaaaaacctattctcaataacagaataaaactaccacttctttctttcctgtaaggttggcagggggacgcggggagggggaggactaccacaatgaccaacacacttccaaaattctgaacttacaggaaatagtatgccaagaatctgtgtggccttgcctgaaagataataaaacttgtggtcactcggaatcctaaggcacactgcaaaagtttactcttcactggaatttctccaggtcatggagatttttaagtgcctcaatgcttctacagtttatttggcaattctacatcccatttccagtcctttcatgcttaggtttaactctcctgtactgagccctaaagaataatgatttcagcagaagagattaaattcatcggtgtgtacaaagaaatgggaagagcagggaaaaactgaaggccacgtgcacacgcagcaacactggtaatactgcttcccatattcattctttggtcttcactgacagcgtgaagaagcaactattgctgattcatcagttactcattttcacaatggtcagtactccaagtcagcggtaaccaatcttttttggcaccagggactgacaggtttcatgcaagacaatttttccacagacagagcggaggggtcagggggtggggggtggtgaggaggatgctttcaggatgaaactgttccacctcagatcatcaggcactagattctcataaggagcatgcgacctagatcccttgcatgtgcagtgcacagtaggatttgagctcttatgagaatctagcgcaactgctcatctgagaggaggtggagctcaggcagtaatgctcactcaccctgctgctcacctcctgctgtgcagcgcagttcctaccaggccatgatgggtacgggtcggacaacctgggagttagggacccctgctccaagtgacccactgaaaggcaacctgaactagcaatttagcctggtaacaactgtcaatggagcaaggcacaggggctcacactcatattcccagcaacctgggaggctgaggctggaggatcacttgaggccaggagactgaggccagcctgggtgacatggcaagacctcatgtctcaaaaaattattatttaaatagccaggaggatcactggagctcagaaattggaggctgcagtgagcagtggccacaccactacactccactcctgcagcctgggcaacagaacgagaccccgtctgttaaataaataaataaataaataaataaataaataaataaataacaagtatcactggaggtatggatattaaccacagaggaatatggaacatagaacttaaaatcatgctacgcaggccgggcacagtggctcacgcctgtaatcccaacactttgggaggccaaggcaggcagattgcttgaggtcaggagattgagtccatcctggctaacatggtgaaaccccgtctctactaaaaatacaaagaaatcagctgggcgtggtggcacacgcctgcagtcccagttacttgggaggctgaggcaggagaatggcgtgaacctgggaggcagaacttccagtgagcggagactgtgccactgcactccagcctgggaaacaggtgagactccacctcaaaaaaaaaaacaaatcatgccagacagaagtccacccaaaaagactttcacagtaagctactgtatttacagtactcaagaaacactaaatgccagtgttctatccgtggtttaaatgtttttaacctcctaaaagcacaagagacaatgctttcatcctttcaaatgtctagatttttagaaggtagcttcccatagggacttcaagtctacttttaaagtcaggactgaatggttaaagcaatgaactagaaatccattggggtttcccggcacaggtctgaatcctaccaattaccgcatcttttcctttgcaaacgtgatttactgacccctcctccagatggagagcctggtatttactacctctcaggaagaagtgtgactgctccccaacctgaccaaactttccccctttatggacccagtaaaaaaaaaaaaaaaaatctgtacatgcctcctaaaggttactggtattctctgactgataaggcaaaaattacacagacgataatctcaacaatgaaatacaaatatgtaatcaacaaagataaaaagaatgctcagaaaagcatgaagccacctttaaagaaaattttaaaggacctgatatttttaaaaagagaatgttcaacatgttaacagataacaataactgaagcaatttgtacatctataccaaattgatcactaggttttcatctctgtattttgagcactgacaataaaaacaaagctctctgaaatgtgaaaacaaaatgttctcatttttcagagacactcctaaaaaaggcatgtttgaaattatctgaaataacaaatatactttaaacaactggcaaatattagcaaatttaagacatattttataaacaaattttaaagcatttttaggccaggtgcaatggctcacatctgtaatcccaacactctgggactgcttgaacccaggaattcgagaccagactgggcaacatagtgagacccgccacctctacaaaaaaaaattttttttttaattagccaggtgtggtggcatgcacccatgggtcccagctactcgggaggctaaggtggcaagatcgctcaagcccaggtcgaggctgcagagagctgtgagcatgccactggactccagcctgggtgacacaaactgtctcaaaaaaataaaatattttttaaacatacacgattatatgtaatacaaattaaagggattttaaggaagctggctggtctcatttagactggggcttggccttttcaactatgaagagaggtgtacacaagaagaaagagattccctaccttgccgcccagtaacacccacatgtgaccactccctgcttccacacgactctgcaaagcagaatcatttaaaaaagacaattctatgacataaaatcctccaactgcttcccactggtcttaggataaagggcaaaataatcaacctatatgggacctcccaagctctgtaaaataaaactctccacctacctcccagccgcgttctcttccttcagccttgttcacactagttccttcaaagcactctgcacctttcccacttggggcactacacaggtaattctctctgctgacctctcactccaccaccatccctccaacctcggtgccaccatcacaacctcagggaagccttctgatccctcccatccaggccggatgtcagtgcactgcactttcttattggattatgtgattgtccacctgtctcaatggacaccaaactccaagagatggcaatctatccctcttgttcaccatactgggatctactcatcaactatttagcgcatgctacctaccagatattgttctaaggcttaggttcatactgaggagcaaaatataaatcttgatctcataagagtttacattcaagtatgagaagacgggccatacataaattagtaagtaaattatatggtatgttatagtgtcataaatactatgaaaaaagtacagcaagaaggggagacaaggagagtgcagggcaggatacaccataatatatgtgactgttgtagcagactatccaaagaagcatgcagctgagagccagccacttccagaggccagtctctatggctttacatagaacaatgcactttcctattcctgctggatgacgggccttacagaaaaatcctgttgcctttcatctttgcatccctagtgttcaactggtcagaacacctgccacaggaagaaaatgaacccttttcttaccgtaatctcagtggccctcctttatgccaggccctttagcaatacttaacagaaaataaaaaatggaaaaacatccactaaagtttaaaagatacattttcaatattgcaattgtttcattttgggttaacatgatgtttttattttaaagcaaaataaaggtaagaaattctatggctatctaaaagggggcatttattttattttatttcattttttttcagacagagcctcactctgtcgcccaggctggagtgcagtggtgtgatctcagatcactgcaacctctgcctcccgggtttaagcaattctcccgcctcagcctcccaagtagctgggattacgagcacgcaccaccacgcctggctaatttttgtatttttagtacagacaggttttcaccatgttggccaggctggtctcgaactcctaacctcaggtgatccacccgcctcggcctcccagagtgctgggattacaggcgtgaatcaaagtgcctggccgaaagagggcacgtttttaaagactgagaaacagtataatttaaaggtcatgtggctaaattactctatctgaaaatactttatgcgctaaatgtagctatgaaaagtcagttaaaaacttgtaaatataacttttatactctataagaaactttctaatgtatgctttttgagtaaagattttcctatttgtttacagaaatgtgcaagtatacaatcagcaaacaatttctctggaacacaggtgggagatgtctttgagcattcttatctctttacttgaattactttcactaaacatctacagtttaccagtccctgggctgggcagaggtgacaagcataaaaagagaatctcactcacaaggagcttacattaattatgtgctaagtaacacaaaggtacacttagttgctacagaaacagagaagcataatctcagaagttaatgcaaagcagtctggaggactcctaaaatatctttttaaggatggtttaaggagctaagtaaatattttaaaaatttttttaaaggaggtggacattcaatttcagtcaaagaatctaccaacagcaatggctacaacgtttgcaacaccaaggtaggagagggaggcgtggtcctgattaaaaggtggggcagggcaagaaggaagacacagaagtggaagcacacacagggcgaggcctagggcagtcctgatgagtttctgaaaagaggccagccatcaggctatgccacactctggctacagtgcgactaaaatgatttgtgtaaataaaagagcattttattgggcaaatttatgcacatcagacttcataaagaacactttcagcaaagatcaagtctcatctctatgattatcatactccccctaaaaaactaagcagtacgctttcaaatttgtgttaaacatggccgggcgcagtggctcacgcctgtaatcccagcactctgggaggccaaggcagatgggtcacttgaggtcagaagttcaagaccagcctggccaacacagtgaaacccaatttgtactaaagtacaaaaattagccgggcgtggtggcacgcacctgtatgtagtcccagctactcaggaggctgaggcaggggaatcgcttaaaccctggaggcagaggttgcagtgagccgtgatcgtgccagtgcgctccagcctgggcaacagaacgagactcggtctcaaaaaaaaaaaaaaaaattgtgttaaacatgaaatactttcaatattgcaatgtactccatggtctaggtctcctaaccagggcaatggggttgatgggaaagaagatgtaaaaccagtagcatcactgaactgcaaatcctttatggttgaaataggagccatgacagcttcaccagaaaaactatgagaagacagagtttataaaggcattgaagggacaaaaggtattaaggtatggggtggcgggggggcagtgagaaagagaagggaaggaaacacagctgagttaataattttccttgttcctaaggaaggcatttacacacaggaaaaacaaagcattagaacgttaggggaaaaaactttcaagttggaatttatctcccttcttttgagaacctagcagttttctaccttacaattccatgttctaaaaaaggaattcattttccaatcaaaataactctagaagtagagtagttacaaagatatcaaccagcataagagcaaaaagtttaaactgaactaaactcagacctgatgaggttaactctctgagtgcctcatttacttcgtactctaaaataagcttttacagaaaaaggagaactcttcacatcaataaagttctacaaaagagcataagcaaggaaacccttacagcagtgtctgtttttaacaaggtattttccaaaaacatgacttcagtgttcatgtcttctccccattggaaaaaggttgttttgagaattttgtagaagaaattacaagaatatactccaagatttttgtgcaatttatcaatctgaaaagaatatccctaaatctgacagaatctataagagtactgtatgcatgataaaagcatatttaaaacttgtacctttggccaggtacgccgtggctcacgcctgcaatcccagcactttgggaggccgaggcgggcgaatcacctgcggtcaggagttcaagaccagcctggccaacatggtgaaatcccaactctactaaaaatacaaaaaaaaaaaaaattagccaggtgtggtggagggcacctgtaatcccagctactcgggaggctgaggcaggagaatcacctgaacccgagaggcggaggatgcagtgagccaagaacgcaccattgcactccagcttgggcgacaagagtgaaagtccgcctcaggaaagaaaaaaaaaaaaaaacttgtacctttaacactaggataaaaacaaatgaaatcgattgatggtaacacatctatacagcttttttacaactttgagaggccctaacatagacaacacgttactaagattagaagacctagattataatcctagctatcactattttgacggaaaatatgaattttaacatgacaatgaaataacagtgaaaggagtttgtcagccactccttggctggtaacatctaccatagcctatcactacaaaaacttgcaaatctatgtagagtagctgcagctacctgaaggcactgttcattgtaaacaccattaacaatttgatgtcccaatttgcatgttttgggggtggggggagacaaggtctcactgttgtccaggatggagtgcagtggcaggatcatggctcactgcagcctcaacctcccaagctcaagcgatcttcccacttcagcttctccaacagctggactacaggtgtgagccaccatgcctggctaattttttgattttttggtagagatgaggtctctctatgttgcccaggctggtgaactcctgggctcctaaactcacctaggcctcccaaagtgctgggattacaggaatgagccacctcacccagcctgcacgtattttagaactacattttaagataatgtgaagactgcttcataaaaacaccttaaatatatacttgtcaaaacttgtgcttacttatggaaattgcattaaattcaataaattctttaaatctcacttttaaaaatggcaatcttcccgaacattaaaccaaattacatttctccctgaatttgctgccacttaatttcagctactcttctacagaatagtacccatgttatctttttttctgtctggttcctactcaaaaagagtggaactgctttctccaaatatgcattctgtgctcagaagctgttttctctgcccagatacatgtgtaaacaagccaaaaaaaacaaaacaaaaaaacaaaaacaaaaacaaaactttctgctaatagattgacagctacaaggtagaatattttaaaaattcagtaagctgggcgcagtggctcactcctgtaatcccaacactttgagaggccaaggcaggtggatcacttgaggccaggagttcgagaccagcctgggcaacatgctgaaaccccgtctctactaaaaatacaaaaattagccaggtgtggtggcatgtgcctgtaaatcccagctactcggggggctgaggcaggagaataacttgaagacctaggaggtggaggttgtagtgagttgagatcgtgtcactgcactccatcctgggtgacagaacaagactccaactcggggggggaagaaaaaaatcagtaatagtgaaaatagcaaaaccagacaacatttccatgtttgtgttacaacagtcctaagaaaatgagattatcatcatccccctgttacaattgagaaaatgtaggcaacacgagggtaacttctaatgaataagccatgcctttgtttcatataaataagtcaactcaactcacattaacttttcaaaataccggataaaatttatttctaaccaatgcaagtttcaaagataagtacacaaattaaatttatgattaaataataagcttgttaatctgatgcctttcggaacgcatttcacttagcaaacctcaattaagctatttcttatatggtttgattacaaaactgcctttcagcatattaaatacaaggagaaaaaactgaaaagccacaacgatttcaacttctgtaaattaccctgactgtaatgaggggcgccaggcaggttggggaagtatggaaattgcacactgcacacaccacctgaccaccaagaaaaaagaggacaccactcttccccactgtggtcttcacaaactacaactcagcacctatttcaagtgcatttaaatattcaaacaactgaaactaagagaaaaaaactttcgaaagggaaaataacttgtctgtccccttcaatgttcaccttggagttgctctcatctctagaaaaaggcctcacgcatactgtttatacttacaaactccactgccctgtcaaggaaaaccttcctgttttctcagttatccaaaacttcaaacttccaatttactattaagacaagttattgggcatccacttagagaatctcaaacgaaagccagataggaggtagttttctacagctaggtttctcaagtttcatctcagccaagttttaagaacgttttacgtaaaaataaggggaaaagcaaaattacattcgcatgaagtttcgacgcacaacggcactgaaacggaaagactcttcacgttcccaagcgcaccctgagaggcaggtgcagcagctttccgatggcttctctgccgcccatgtatcccagccccaagaccaacacaggcaatcttcacatctgactttatttttttaactccttcagatccacctctgctcaagtctatcaacaggaaaacaggagcgttccaaacacacaccgagcaacaggatcccaacttcctggttctaaaggaatgcgatgccctgatgacccgtcccgccccgcacccgcacggccgcctatccgggctccggcgggaccgaggagcgagtggcaaggctggcgccgcactgcgggtgccggcgcccgcccggcctgggggcgctcgcggcccgcgaccccggccccgcccaggccctgcccgacccccgtcctcgccggccttcgcccaaccccggcctcccgaccctgaccccggcccggtcttccgggcacccagctccgtcgactcccgcctcgcctcaacgggtcctcctaagccccggccccggccttcccctgccccggcctcggccatcctcagccccagttttcccctgccccggccccggtcctcctcagccccggctttttcctggccctgaccccggtcctcctcagccctggcccttcccgtgccctagccccggtcctcctcaacccggccccggccttcccctgccccggccccggccccggcccaggcccggccctgcccgccgcggccgcgtcctccgggaagatggcggcgcagtgacaggcggcgcggcgcgggtccgagctgggccgggagggacggcccgccgcggcccagggtgcctcacctgtcagcgccgccgccccgcccgaccggccgcccgcgggctcctcgcctcaaccccggggcccggcggccgcgccacacgcggggacggcgaggagagagacggcagggagaggcggcgcggccgggccgggccgggccggaggtaggggagagggcgggcgcgagctggcggcggcggcggcggcggattcttcccctttcgggcccgaaaatgtctcaaccccgggactccagatccccaacgctccttcccgttcgcatgagaacacacagctc

SEQ ID NO: 274 - DNA, 29360 bp, Homo sapiens
  source 1..29360: mol_type = genomic DNA
ggaagtcccacctgcgcccgacggcggaagttccgggagtgccaagtacccgcgtgcatacggctgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggttcgttgttctcgtgatttaacgtttcataatttttaagtcattctctttcactgttagatttgggaatacctgttccttttcagaccatagtaggcccagactaaatttttacagcgttggttggtgtggcaagaatgagtcaacaagtgttgagtattaggactttttttttttttttttttttttgagacatagtttttcgctcttgtttcccaggctggagcgcagtctcggctcactgcaacctccacctcccgcgttcaagcgattctcctgcttcagcctcccgagtaacagggattacagtcgtgcaccaccacacccagctaattttcgtatttttagtagagacggggtttcaccacgttggccaagctggcctcgaactcctgatcccgggtgatcctcccgccccggcctcccaaagtgctggaattacaggcgtgagccactgcgcccggccctagtattaggacttttaagaagtcacgtttttatgtagtgaacattcgatttgggtcgcaattacacagacattgacgggcaactggagcctcccagggactcctgcacgagagggagttactgaagtccctgcagagtgactgttttcccctcgtcagtgcctccttttcttcaggtctcaaggacgggatgagcttgccttggaaagctttgtgggagtctcgtattttaccttcatagcaaaagttgtttccccacttctctccaccatttcttatttcttcctgacagttgttctggcacatctcttgatcgattgtagtattttctttctttctttttgagatggagtctcgctctgttggccaggttggagcgcagtggtgtgatcctgactgcagccaccgcctcccaggttcaagtgattttcctgcctcagcctcccgagtagctgggactacaggcatgcgccaccaggcctggctaatttttgtattttcagtagaagtggagtttcaccatgttggccagactggtcttgaactcctaatctcaagtgattcacttgcctcagcctcccaaagtgttaggattacaggcatgagctactgtgcccagccagattgtagtattttcgagtgcaggagtcatgtcttatttgtatttttggtcaaccatctctcaggtttgttgaaggaatttgctctttggattatatgaactttgttcatgttattgacttatgtggagaactttagaatatattatacaccatccgtcttctgttctgtggagtgagatttatatttttagagaacagatgacttatctaaaaactgggtgatggtaattgtttggtgattggaagtaaaaaaaaaaaatcacatcgggaaagtgtggtattcagttcattctagaagatgttgagtgagtgcctgtcctgtgcatcgggtactgtgttacaaaaatgcattagataaaatacctgcctctttggaagtcattttcaagagaggtaagtcgaggccgggtgcggtggctctcgcctgtaatcccagcactttgggaggctgaggcgggcaaatcacgaggtcaggagatcgagaccatcctggctaacacggtgaaaccccgtctctactaaaaatacagaaaaattagccaggcgtggtggcgggcgcctgtagtcccagctgctggggaggctgaggcaggagaatggtgtgaactgaacccaggaggcagagcttgcagtgaaccgagatcgcgccactgcactccagcctgggcaacagagcaagactccatctcaaaaaaaaaaaaaaaaaaaagtggggtaagtcatatctcgtatgaccatactagaaataaaacattgttatcatggaggacacacatggattgggagaggagaagagtgtggttagctgtggtaagttggagagtcagggggaaccttatgaagtaggtaacctttgacttggtcccccttcaggatgtgcgaacggcattaggtgcagaagaacgtagagaagatcttgtgtgggcccagaggggagaccgtgtgtgcccctcatagtacttggcagactgttgtgaccacccgtttacttgtctcacttgtaggcccagaggggagacagtgtgtgccccttatagtacttggcagactgttgtgaccacccatttacttgtctcacttgtaggcccagaggggagactgggcgtgcccctcatagtacaatacttggcagactgtgttgtgcccacctgtttacttctgtcactggaccctgaattccgtgaaggaagggacagtatcttgttcattatcctcagcacccaagtatccctaacaacctttgtatgaaataatattgagttaatcaaattgttgaattaatcaaagtgttcaagaaaaaaggtcaagtaatattgtgtggctagatacattggatttaggaatcctggggatcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgcgtagctgggattacaggtgcataaccacgcctaatttttgtatttttagtagaaatggggtttcaccatgttggccaggctggtcttgaactcctgacctcaaatgatctacctgcctcagcctcccaaagtgctgggattacaggcgtgagccaccacgcctggcctgcctgtttctttagctgtagaaaagcaagagcagaaactgcctggcaaactaacaaagccttatgacaccatgtgtggggtaatgtggttgcaaggttaattgaggttgtgaagggcgtggggatcagcagtatagtctcaaagcctaaatctgccgttgccccagaatagtccctgaaggcaggtgtaggcagagagaaatgtttggcttctgtgacagtacttcatatttaaacaagttataatggctttttttttttaagccagagtatcacaatctcagctccctgcaacctccacctcccaggttcaagcgattctcctgcctcagcctcccaagtagctgggattacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagagtacctgggggtgaagaaagtgatttaagaatgagatttttgtttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttggcctcccaaagtgctgggattacagacataagccacagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagtcctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaaatgtagacgacatttaaatctatctgagatcaccttggaagggaatgtaggaagaagggtgctgtggggagcatgaatgtttggggtagagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccataggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcatgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctggagtgcagtggcatgatctcagtccactgcaaccttcacctcccaggttcaagtgattctcctgcctcagcctttcgagtagcagggattacaggtgcacaccaccacgaccggccaatttttgtgtttttttagtagagagggggtttcaccatgttggccaggctggtcttgaactcctgacttcaggtgatctgcccgccttggcctcccaaagtgctaggattacaggtgtgagtcacactgcacctggcaagagtcttgtctttaaacagaacaaatatcttggtttatcaagaacttgaaatttctccatcatcataaagaaaactcatctgagctcttgggatgcataagaacaggtcgcatgtctctgatataattcaggggaggcagccagctgccagtgtggatttctgcattttcttaacataaaatgaaattatctttgtgtcatttctaactctgttatcagaaatggcatatatacagtttaaaagcgtgaagcaggctgggcacagtgattcacgcctgtaatcccaacactttgggaggccaaggcaggcagctaacctgaggtcagaagttcgagattggcctggccaacatggcgaaaccccatctctactaaaaatacaaaaattagctggacgtggtggtgggtgcctgtaatcccagctacttggaaggctgaggctggagaatcgcttgaacccagaagacaggggttgcagtgagccgagattgtgccattgcactccagcctgggcgacaggagcgaaactctgtctcaaaaaaaataaataaatacaaagcaagaagcaatgtttccacactctaattttgtaaattgtgaagaaagtaattcctaagacatgggagggttctcagttatcccagtttttgtgttttatgatgtcgctggtaaaaagaggagtcatttctctcaacatcatggctagcatttctttgagctctacagggttcctcctcccttttttgatgtttaaatagtatgtacttttctgtcactggtttattttgtggtattcagtttgggagacctacttttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttcttttttttcttcaacactttgaatatatatcatcccattgtctcctggcgtgcaaggtttctgcaaagaaatctgctgttagtctaatggggattttcttatatgtgacttcaagcttttctctagctgtttttagaatttcctttatatttgacttttgacagtttgactataatgtgccttggggaagacctttctgggctgactctatttgggaattcttgaacttcctggttttagatgtctatacctctccccagtcttggaaagttttcagctatctcattaaataggttactaagccttttcccttctcttctccttcttgaactcccataatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcaggtttactctctgtggtggatctctgatcctgaagcacccctagcagcttaagcccacagggcaaggctgtggctgtggctccacccgtggggtcagggcacagtcctggcctgactccagggaagacgcactctggaggtttgagcctgggaagcagggtagagctgtacttcagaaacctgagccagtagggagggcttagtgtcagctcaaggggaactctggaccctgggatggtggggcccagcagtatcccagactctctgatgctaggtgaggtggcagcaaggaccccagaatggactagtccagctgtcatttgggccctagaggacagggaggaggacagcagtgactccatttcctggaaagagtggtgactctgcagctcagaatatagggttagtccagctccagggagcaggtgctggagctgtttgcgtggtggggcaggtgcctcggctcagcccctgccctgtttccctggggtgtggagtacaatgtcagctcctccccatggtatgtggctggtcagcctgggcctgagggttgtgactcttctgggcgccccaggcaccgttgccctgggatacaaggtacctcttcagcatagacgctgggatatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagccgcagttccagtcccaagatgatggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggctaattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatcccagcactttgggaggctgaggcgggtagatcacccaaggtcgggagttcgagaccagcctggccaacgtggtgaaactccgtctctcctaaaaatacaaaattagccgggcgtggtagcgcatgcttgtaatcccagctactcgggaggctgaggcaggagaatcgtttgaacctgggaggcggaggttgctgtgagctgagatcatgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattagtttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtcttgtgtaaagatgattttattgttgtgtgtttatgtaatgctgggtgcggttgagcatgtttgtctgcttattggccttttcaaagttctttaggctgtttatctttttctcgctgatttgttacttttgtattacaaaggttggattcttgtcagatacattgcaaatttttttctctttttgtcacttgcctttttaacttcaaatgtgctgtacatttttgaactattaacatatattaatttttttttctgggtgttcaggtttgcattgtacatagaaaggcttaccattcattccaaagtcattttaaaagtatcttttcttgctgggtgcagtggctcacgtctgtaatcccagcactctgggaggccgaggcgggtggatcacctgaggtcaagagtctgagaccagcctggcaatcatggtgaaaccccatctctgctaaaactacgaaaattagtcgggcgcgcacctataattctacctattcaggaggctgaggcgggagaatcgtttgaacctgggaggtggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgataatttctctttctattgcaggaacgagatcttgagctggaaatgggagatgattatattttggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccacccacccaccccggacactctggtggagatgctgggccccttcgttatcctgcacccctccatcctgactctgcctcctgcacctcttccctgtcccgacactggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctggatgggctctgctgtgctgggcccttcattctcctgcatccctccatcctgactgtgcctcctgcacctcttccccccaccccgagactctggtggagatgctgggccccttcattctcctgcatccctccatcctgactgtgccccctgcaccaccttccccaccctgtatctccgccaggcccttaatggactctgctgtgctggaccctcttccttgggggctccgctgtgtcacatctttttcctgcctcaatcccctccctacttgctttttcttagcatataaaagtccacaagttttactcatctttttaaaaaacgaaaacatccttagaccgtgtcctccattagttgctatcctgccttcttctctcagctgagctgtctgaaacatgctaacatgcttatacaatacttgctgtcctgccttctgctctcagctgagctctctggaacatgctttttatacaatacttgctgtcctgccttcttctctcagctgagctctctggaacattctttttatacaatacttgccatctgcatgtcccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttttagtggagatggggtttcaccatgttggccaggctggtctcaaactccttacctcaagtgatctgcctgccttggcctcccaaagtgctgagattacaggcgtgagccaccacgcccggctggttttcttgttctttaatttctgcattaaatctggactctttaggccgggcgcagtggctcacgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagattcgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctgatggttgtccctttgtgttcatatcagtaacccccaaaatggggcagtgagggagagagcattgtttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagtggacctggggtcctgagcgctgagcctgggagtggacctggggtcctgagcgctgagcctgggagtggggctggggtcctgagcgctgagcctgggagtggggctggggtcctgagctctgagcctgggagcggggctggggtcctgagcgctgagcctgggagcggggctggggtcctgagcgctgagcctgggagcggggctggggtcctgagcgctgagcctgggagtggacctggggtcctgagcgctgagcactgagcctgggagtggacctggggtcctgagcgctgagcactgagcctgggagtggacctggggtcctgagcgctgagcattgcttcccctgctttgcaggcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaaggtcagtctctgtgttgtgtaatgtaataaaatgacagtctctgttgtttattgcacagggttcagggcaaacaccagcagttgccatttgcaggaactatggcaggggttgtgtgtactgcatgccctcgttttgtggcatcctttagaggagagcacgggtcagggtgcaggtggatgcccctgacagctgccctggatggacccctccttggcactttgcttttgcggagggtggccagagcatggtctgacagcactagcagtctgggcttagaccctgctgtctgaagagggccaggaagtggccacagctgagcaccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccattgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaaca

SEQ ID NO: 275 - DNA, 6953 bp, Homo sapiens
  source 1..6953: mol_type = genomic DNA
atgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaacactttctttggtaattgataatttccaaaacctcgattttagctaagtaaatttttgtggactcaagtctgaatgataaaccggctttggtttcttggttccagtaaacctgtctgtcttcatttaaagaactaaccgtgtcacacacacatcctcaacagaaaaccccgtagaaaccggctagcgttgtcaggagaacatccatcctctcttaaacgtgttcttgagtggatgaaggtaacacatgctcacaggatcctggacattctttctacacttgaatttctttcttttttttttttttgagatggagtctcgctctgtcgccaggctggagtgcagtggcacaatcccggctcactgcaacctctgactcccaagtagctgggattacaggcgtgtgccactacgcccagctaatttttgtacttttaatagagacggggtttcaccatgttggccaggatggtcttgatttcttgaccttgtgatccgcccgcctcggcctcccaaagtgatgggattacaggcgtgagccaccacgcccggcttgaatttcctcttcggtgtgtggtcgacagattcctgcacagtctcaaccctgcctgggacacatagggactcacactgccccatccacagctacattcacagccccattcacagccccattcacagctcattcacagccccatccacagccccatccttcatcctcatggtgcttcatgaggtcaatggtgtagatccagcctggactttgttcaccgtctgcccgctgccaacctggactcccgtggacacagctgagactggatgctgtgtgtacctgctccccaggaattcccagctctgcttgcagacgcctctgggctgccctcctcactccgatggcatccttttcttccagttctgctgggttgtataatgggtggctactacaggagtcggtaaaataccctggaaaaaatgcatgtgggaacatccctctttattcctgaaaagtgaatatattaaatacaaatgcagatgcttcatgtaaaaccatcatccgtcatcagcagaagacagcctggcggggggagtgggtttgtcatgggctctcagagcagcactcgcctccagcctccacggctgtgggcttggtgagggtcttccacatgaccacctggcggggctggccctgaccgctcctgcggcccttcctgcagatgtgcacacacatgtcccgtggcactatcccagtatgtcttaggagagggactggttcctactcagttttgtacccacagaggacctgagatgccatggggtggcgggaggaggtggtggggctgtgggctgggtggctgcaccagctgggctgaggaagctgggctgcactttgagggtggtgatcagtgagcatggtttcacaggaagactgctggaatacctttgaccaagtttccttactgagaggttctacttaatttacccaagtaacagcaatagcgctatgacgggaggtcacactctcctcagtaaatctctgttccctctcgttcctcagaccctcagtgcttccttcggtcactctgcaaggagtttggctgaagttgaatccactcttgcaagtacaagagctggtactcccacctgcccctatgtatcctggaggcggctaacacatgataggaaatcttagctccaggggctttatttgcaaactgttgactatgtactacagttgaccctcttaactttgcagctcctgaatttttctgaaacaaactttgcattcagctccatcaaggagcccgtgagtacaacttgaccagcaagtatggtggtgggtttgggaatgggcaggatgtacccactgcggctccgaggaagaactaagggaggagaaaacctcggccacagctggccgtgcttagccattcgctttaatggctcaggcaaggtctggttttgaaaatttgaggacagcctaggccaaaacactttaaatgaccacaattgacgtaaatgctgttcccctctaaaaaattttttggccgggcccggtggctcacgcctataatcccagcactttggaaggccaagacaggcatatcacgaggtcaggagatcgagaccatcctggctaacacggtgaaaccccgtctctactaaaaatacaaaacgttacccgggtgtggtggcgggcgcctgtagtcccagctacttgggaggctgaggcaggacaatggcgtgaacccaggaggcggggcttgcagtgagccgagatggcgccactgcactccagcctgggtgactgagccagactccatctccaaaaaaaaaaaaaaattttaagttgtaattttaagaagtacaagataattaaaactctaagacctgtaagataatttttattattattacctagttaattttatgctaaatgctattttaatcccctaaatccttaggttgataaattcctctgcatttaagtaacttgccgttgcaaagaaacaacaaaacaaaaaaacccagaaactcatatagtttcttacttttttaaaaaagaaaacccagcctactgaagagctatcagcataattagcatctgcctaagctgccgattttctgcaggatgagctgccagctcaccacagtgcggcactgagcaccagagagttcctgtcccagattcctccggtcaagtcacatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactc

SEQ ID NO: 276 - DNA, 21565 bp, Homo sapiens
  source 1..21565: mol_type = genomic DNA
acatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactcaatgtgcaagttgaaccagggcccttttataccctggggatgtagaaagatatcagctaaggcaatctgatatttttgtattcttaacaagaaaacacaccccggtctctctctatctctccatctctttctctctatctttctccctctcaattgagggataatagaaaattgttttgacacaatctcactttaaaaaatgcttttagtttttaaacctagggtaagttattttctactctatggctttctttttttttttttttttaaggtgatgtctagctctgttgcccaggccagagtgcagtggcgtgatctcggctgactgcaacctctgcctcccgggttcgggcgattctcctgcctcagcatcccgagtagctgagattacaggcgcccgccatcacgcccagctaatttttttgtatttttagtagagacgaggtttcaccatgttggccaggctggtctccatctcctgacctcaggtgatccgcccgcctcggcctcccaaagtgctgggattacaggtgtgagccacggcgccgttcgatggcatctttttaattcacttgctgtatatatcatcccagattttaaaaagaaaaaataaaggtggcaaatggaagagaaaaataataaacattgtgactaaaattactgaataaattcttaggatagctgaaaatcgataaataaatgcaagaccttggaaaccaatgtgtttggaagagctaaaaaactgtataatttcttgcctatcatattccaaatatcatctaccaactaaagctctaggccaaatagttttgcaagtagggtctcttaaaatatcaaaaaaatgtttgccatatctgtcggttctctcagggaatatgaggagagaagcacgatggacgcatgactccgctgactttggcacggataatacagaacaaaaataacacagcagcagtgatgggtaatattctataaaaagattaatgtgttttgctcttttgtctttccataagttcacctttatgcatgtaatttttagttacgtagaaaatcaaaaggctatgcctgaaatgttttccctggaaatcagttctgagactcaggaataaatggtctgtttgaaacttgtttcttttgcagtcagaagagtaagaatgggagaatgatactcttttaaagatctaaaaaataataaataagtctatgaattaggctttgaggaagaaactaatatacaataccgtacctattataatccaacaactctaatagtaataataataatagtaagacagccagacacacattgtgtccttcctttgtgccagtttctattttaagagtttaatgtatattaattcatttgatcctcacgacagctttctgagataagcgttattttttattatcacagcatcgataaggaactgaagcacagagaggtaaattacctgcccaaggcaatgtggctgcagatgcagctgagcccccagaatctgtgcagtttaacatgttgggatcgtcaccaccaaactaagcactgaaagctttagaggcaaatgttatcaaaatttcaaggaaggaattgtcattctctgtaaaatgttctaggggataaaaaaggagggaaaccctttgctaggttgatctgggtacaaggttctgacacataaagcacacaaaaaacattataaaggaaaggaaggaagacattttgattaggctatatgcggagaattttcttaagagaggttatgacaactttaagaatgacagttgatgacctataatgctgcaggtaggaggttaagaataaactctaggaatagatgattacatctgattaaggcaaattagaagcaacagaaagggctctagatatcagtgaaatatagagaaggacatggaggccaagactgggaaaagcaggtaaaaagaaatggaagtggaaagagttaaaaaggagtaggccaagtattgtaggtatgaaagagagggtaaaacaaatacagcatgtgctaaaaggggtatccttgaacaagagagccataataataaagaaaaatatcccagacacacaagatgacttaaacccacagatggaaagggcttgccatgttccagaaatactgacacattatcgtcgacactggggtaaacttctcagatctctgagaaaactgctgcatgcagaagagaacagccactcccaacaccatcactccatctcctaggcattgtacaaccctaatcctctgctttccacctagaatgatgggtgatccatgtacttaccaaaagtcacttcttgggtcaggtgtggtggctcatgcctgtaatcccagcactttgggaggctgaggcgggtggatcacctgaggtcaggagtttgagatgagcctggtcaacatggtgaaaccccatctttactaaaaatagaaaaaagggccgggtgcggtggcttatgcctgtagtcccagcactttgggaggccaaggcaggtggatcacgaggtgaggagatcgagaccatcctggctaacacggtgaaaccccgtctctactaaaaatacaaaaaaattagccgggtgtggtggtgggcgcctgtagtcccagctactcaggaggctgaagcaggagaatggtgtgaactcgggaggccgagcttgccgtgagcagagatcgctccattgcactccagcctgggcaacagagcgagactctgtctcaaaaacaaacaaaaaacaaaaaataacttcttctgcagcagattcacccacagtcacctactcaaagacatcgtccagcaattttccctttttcttctctatcatcacgttttctctctctctgttggaattctcctatcagtctgcaagcatgtgactatgatttcatttaagtaacagctagttttttagacctcatttgcccagcaagctactcctttgcaggaacactcttagaaaacttccttcatgctcactatatccagttcctttctctaatatttctcgttccttttctcacgtttaaaactatcaagtaacttaacctaaattgttaagtacaattgttgagctgttcaaattttcaactcctgtcaacaaaattccaaagaacaagcttctaagataagcacttcctgatatttgataacataggttaaaatttctgtaaatatcttaagagattatactcaaatccatatgttggaaaacggtgatgaataaaattttggcagtgaggaaaataaaaataactttccataatagggttatttttatctatataaatcaagaaagaattaacactttagcaatgatcagaaaagatgaggcccttggtattactgggaaaatttggaagagataattaatttgggagagcttctagaacaagtactcagaagtgttcaataataagtaaaatgacacatatgtaattgatgtcttaaggctgatgacagcagccctcctaaatgaatctgcagtttgctactaaatccatacaattcgcctcctctaatatatacgtattttgagacggagtctccctctgtctccaggctggagtgcaatggcatgatctcggctcactgcaacatccgcctcctgggttcaagcaattctcctgcctcagcctctcgagtagctgggactacaggtgcacgctgccacccctggttaattttttttttgtattttagtagagatggggtttcaccactttgcccaggctggtctcaaactcctgagctcaggcaatccgcctgccttggcctcccaaaatgttaggattacaggcgtgagccactgcgcctggacctcctccaatatttggccaagccacgcaatctttaagctcccatgtctgtccatgattgtaggtttataatttggaacttcggttatttaattaattaaaaatattcagatatatcctgcaaataaatacaaagtttttgtactcagcatctttagtgcactttcccacaaggagttgtatgtaaatgaaaaaaatagataaatgcaagcatgtaaatcaactcctattattaaccatttacttagctcaagtttatttacacctgaatgaaaagttccatttgcatcaaaaatacattcgtatactcttaaggcagtgtccggcgcagcggctcacgcctgtaatcctagcactttgggaggctgaggcgggtggattacttgggcccaggcatccagcctggacaacaatggcaagagccatctctacaaaaaatacaaaaacttagccaggcatggtggtgtgcacctgtagtcccagctactctggaggctgagatgggagaatcgcctgagcctcagaggtcaaggctgcagtgagctgggattgagccactgtactccagcctggattacatatatttgtatattcctaaggcacataatggacctaggtcaccaaaactaaaagatattctagaccaaaattttgaatgtaatttaataaccttgtacaaaccctctacagctgcacattaccaaagctagtatcactgtacctagtggcttactgcctcattcaattgaaaagatcaaactaattcaatcctgctctccaaagaacactttttctgaatgggctctcagacttttcctgaatgggctctcagattctgctttcctaagaaagtgtgttgaggtagttctttttctgaatgggctctcagattctgctctcctaagaaagagtgttgaggtagttctttttctgaatgggctctcagattctgctttcctaagaaagtgtgttgagctgtagttctacagcattgttcaatgcaaagatagggttggctgtaggttttcagaaggtgacctttatcaggttgaagaagttcccttctcgtcttactttcttgagattttatcatgaattgatgttgagttttgtcaaatgttttttctgcatttctactgaaatgagtcttgtgtggtcttttcccctttattctagcaatatggtgtatcatattaattgattttcagatgttaaactagccttgctttcttgaaataaatcccacttgggcatggagaatattctttttatatgttgctggtttctgttaatattttaagatttttgtatctggattcgtgattgataatagttattcttgtaatatctattataaatagttactgtgtggcttggccaaatactggaggaggtgaattgtatggattcagtagcaaattgcagattcatttgagagggctgctgtcatcagccttaagatatcaatcacactgggcgcagtggctcacacctgtaatcccagcactttgggtggccgaggtgggtggatcacaaggtcaggagttcaagaccagcctggccaacatggtgaaaccacatctctactaaaaatacaaaaattagccaggcatggtggcaggcacctgtaatcccagctactcgggaggctgaggcagagaattgcttgaactgaggaggtggaggttgcagtgagctgagatcgtgccattacactccagcctgggcaacagagcaagacaatgactcaaaaaaaaaaaatatcaatcacatatgtgtcattttacttattactgaacatttctcaatagaaatctttttgctatatttgagatatcccgttttcttctgcatatgcttttgggaggtaggataactaaaaatattatatataaaatataaaataacaatatataaaataactaatatgataactaatataactatatatagctatatatacctacatataactgcaatataaccataatatataaaataattaatataacatatagattagttataaaataatatatataaaactaataaaataacaccaatatataaaaaatataaaataactaaaatacattggtatagtttcttgtaataaccaaaagaaagtgttcctttttcctctatttcttggaagtgcttatgaaggactggtaatatttcttattttttattatttttgagacagagtttcgctcttgttgtccaggctggagtgcaatggcgcgatctcggctcactgcaacctccgcctcccagtttcaagtgattctcctgcctcagcctcctgggtagctggaattacaggcgtgtgccaccacacccggctaattttgtatttttagtagagacggggtttcaccgtgttggtcaggctggtcttgaactcctgacctcaggtgatccgcccgcttcagcctcctgaagtgttgggattacaggcgtgagccaccatgctcggccaatacttcttctttaaatgtttggtagaactcactagtgaggccactgggccttgtcttttcttcatgggaagattttaattactatgccttagctgggtaatacaaagatgtacctgcattatttcggattttcatcatttgtgcattctctctgttcttcttgatcattctagttaatggctttttccaactttgttgctcctttttttttttttttttttttttgagacagtctcactctgttgcccagggtgaagtgcagtggtgcgatcttggctcaccgcaacctctgcctcccgggttcaagcaattcttgtccctcagccccctccccctgcctgtccctccttcctcctgctgagtagctgcgattacaggcacacaccaccatgcccggctaatttttgtagagatggggtttcaccatgtcacccaggctgctctcaaactcctagcctcaagtgatctgccaatcttggcctcccaaagtgctgggatcactagaagcttttcaatttttttattccaaagcaatctgatgcagtttttgctatatttgagatatctcattttcttctgcatatgctattgggagataggaaagattttggaaaatgtgtaagaaaaaggaagatactaaaaacatactaagattgtatgtagggaaaggttacaactctaactttgataatgtgcattaaatcgacaaatccttgaaaagcacagctcgataaatccaacaaaaggagaaaaagaacatgtgaagagttgaatatatgtgaaagaaatgtaagttcatttttctttttttttttgagatggagtctcgctctgtcgcccaggctggagtgcagtggggcgatctcggctcactgcaagctccgcctcccgggttcacgccattctcctgcctcagcctcccgagtagctgggactacaggcgcctgacactccgcctggctaaatttttgtattttttagtagagacggggtttcaccgtgttagccaggatggtctcgatctcctgaccttgtgatctgcccgcctcggcctcccaaagtgctgggattacaggcgtgagccgccgcacccggtcgtaagttcattattaaaatgggccccatatccacgtgaataggggtcagtctcagacttagctttaattttcagccatgagaagactactgctcttcctccaacactcacttctctattttctctatcgtttgatcctgtctcctgtacaactgggtggtatttaaccatgtttaggctcaggtataacccaagctctgaaactgtaatagaaaattaagtaaatgaaaggcaaaaaatgaaagacttaataaggtttaagctgttattcatctaggaggctgaataacaatacatatacatgtttttgttgtttatgtgtatatattttttatgaatagagttgttcctattatgttgtatcttgtaataattactaatgacaaggttcataaatagctagatgttaacataactggccaaactccagtgacaagggccctgttacaatcagtaggaccaacctgctaagacctgagctcagagctcagggatggccaaggtcaaggcccagtggttgtgacgagatgccaggaaaccttacccactgcatgcctgtgttgtgccatggtgctgtaagtagtctctttgggtacactgccagtaggcttttggcatacatgtatgggctagtattttcaggccaaaaaactatccctgtctcattgtttactatttttgtgcagcaatttggttttactgttggttcttactctggtcttgccccaagttcaatactttggttcttctcttctccctaaactttccctgtcctgattccctgagaacaattcccttttctctgaattgggatcctatttctaccccttgcatacatacccctcctaattcttctgggtaaatttctatgcccattaactctagacatacatttgtaaattactgagaccctaaattgagaattatgtttgccattacttttaaaagtgtaatctgaatcccagcactttgggaggccgaggcgggcggatcacgaggtcaggagatccagaccatccagactaacacggtgaaaccccgtctctactaaaaatacaaaaaaattagccgggcgtggtggcgggcgcctgtagtcccagctactcagaggctgaggcaggagaatggcgtgaacccgggaggcggagcttgcagtgagccgagatcgcaccactggactccagcctgggcgaaggagcgagactccgtctcaaaaaaaaaaaaaaaagtgtaatctgtttttttgcctcctgaaatcacttatgtataaacacattaaagtgggtcaccgtgtcacgtcttgggcttcctgggacaagaatcaaatggcacatgcctggccaaagtgctcagatcaatctgcaaaccatggtcacagagccagtcacagagtcttacggctttcattgtagcttctctgtggaatatcttcaaggacatgtgtgtgctttaggatgttcacgtgtcatgattaagttgtaaatttcaaaaattctaagaatgcctattgttggccagaagtataaaaattggaaagattttaataaaatcatctttcaatcttacttaaataggtctatgaagtctgcatctcttcctctggaaagtaacgtaagggctgtgaagaacattgtccataatgaaactgagaagggctgttctccctgggaacagaaaggtcactgtctttgctcaacaaacagcctaaagccaggaacgcaggcctccccaggcctcttggccgcctctcaagcttcctcaataaaaaattcacatggaagacattctagtctatcttctcttccttctttcttccctttagctaataattattgagtgctgattatgttctggacacagttctagaatttctgtgataagaaacagagaccccagcagtgattctctgctggggccgatggctctcagggacatccttcaaaacagggcccatttggttctttaaaaaaaataatgtccagtttctctaaaaattctgtcatgacttttatttctttgatgttaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtatgacaaagacatgggggttgtttggagtctgtgatgtgctattgtcctccacataatggttttctgcaagaaactagagaagtaactatctcagatttccctaataaaaacaggttttgagccaattccaggctggccctaaattcctcttcctagcacgtgaagcctgggaagctctccgtgggccttgccctcgcagctctcacccctggtctctgctcccccattcctgtctggctattggaagcacctctccattgcccagcctctctgctcatttactggaactgggcaatgccccttgggaaaagcagcacaggttttcttctcctagattttgccctatgcttcttttcagagctatttggtctctgacattctctctcaggtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgtgagtatatgcttaagttttttttgtgttttttttttttggttgagatggagtctcgctctgtcacccaggctggagtgcagtggcacgatctcggctcactgcaagctccgtctcctggattcacacaccattctcctgcctcagcctcccgagtagctgggactacaggcacctaccactgcgccctgctaatttttgtatttttactagagatggggtttccccatgttggccaggctggtctcaaaactcctgacctcgtgatccgcccgcctcgacctcccaaagtgctgggattacaggcgtgagccactgcgcccggccaatgcttaagtttttattcataatttactcaaagtcactgagctctgacttcatgctggtgattcagatttgagtcctgggaagatcatctgagatgacgtttaagccaagggtttaaatgagtcatattcagccaggtgcagactaaggcagtgcaggttccaggcagaagggaaagcacgtggacacgctgagatgcaggcaaggcctcacagccagagctggcttgtcacctggcgtgggaacacctttcctcttcagactctgtgtgttccttttaatctgcgtcagggcatgtgattgagcagcacgtgaccaaccccactgcggcatctgtcccccgtggggtgggggtggggacagagttcttttcctacagcataagtgtgtcatgtcaaccaacgccgtgtcagctgcctgcaggggcccacgggcatggggacccgacgtacaccgtgggagctgacctttctttcttctctcaggagtggagccccaacccacgcagggcgtgtcttcatggcttttcctggccaatctgataccaagatgcagtggccagaagtacctgcacttccactcctgtcaaggtgagatgccacttgctctccactgattctctatcagtgctgagctctgttctctagagctcacggattctatattgtgttaagctgtcacttaaaagtgcacaaattgtttcaatcaatcctaacatattcacccatgtaattaacaccctatcaacatagagaacacttcgaaaatcacaaggctccctgcgccccctggaagtagcttctattcttgcctacatcttaattggtttcgcctgtttttgacctttatttcactggaatcacgtatgccttttgtatccggcttcttccactcaagattgggtctgtggatttactcacactgctgtgtatagcaggactgctcccgcggcatggcagcatccgattgtgcagacaccaaggctgatgtaaccactgcagatgttctgcaggggcgtccctgggatagagactggacatgtagcaaagagctccgtgagcgtgagcgaggcaagccctgaacccacactgtatcacctacttatagggcagtgcataaaaatctgggaaacaccttgtttctcaaagtaacaacgaatatgtcagtgacttcccagcccaagaatatgctgcattcgttcgctgcttagttagtaaaatggcaacaaaagaaggcagaaccacgcacatttgtctcctgccaggtctgactcgtttgactttagtagatagtggccaacagcttcatggtagcaggcatgctcagaagcagttactttatattccgtcaacacttggtgatgttggtcttttaaattcgggtttcaatttgcacctaccctgtgattaatgaggttaagcttcttttcatgtttaacacccaaattttaatagactttattctttcgaccagttcaggttcacagcaaaattgggtggaaggtagacagtttccataaacccccagcccctccacacacacagactcccccactatctacatcctcatcggagtggtccatttgttacagccgatagacgtacgtcaacacatcattatcacctggagtccagtttacatgaggcttgctcttggtgttggacaaatgcataatgacctatatccaccaattcagtaccatgcagaagagtttcactgccctaaaaatcctgtgccctgcccactcattcctccctcccgtcacccctggctttttactgtttccagttttcctttactggaatgttggagaactggactccttcaggatgtagcctttcatgcttctttcagcaacatgcacctaactttcctccctgtctttgtggcttgatagctcatttctttttagtgccaaataacatcctactgtctggatatatcagtttacttatgcattcacctatatgcatataaaatagaggagagaatgcggtgttggagatttacgtttgggagtctaaaccatgtatggtaaataagtataatgtgtgaaaattgtaaagcagaaagctgtcaggatacctgaatacacacaaatacacacttcagttcatgctataaaatgttataaaatgtgtaagtacatacttagggctgaaaaagcacccagagaggaagggtgaagaagaggtgtatctgaaataataaaaagaaaatctgtcaagaggggatctagagtacctcatcccatgaggaactcccaaccctagtgagggtccaacggacagatccaagtgagaggatgaaaccactgcacaagcaccccctaaggggcaggtggagggcagttcccacagggacccacttcgggtacaacctgggcttgtccccagggagcaggtggagggcagttcccacagggacgcactgcgggtacgacctggacgtgtccccagggagcaggtggagggcagttcccacagggacgcactgcgggtacgacctggacgtgtccccagggagcaggtggagggcagttcccacagggacgcactgcgggtacgacctggacgtgtccccagggagcaggtggagggcagttcccacagggacgcactgcgggtacgacctggacttgtccccatggagcaggtggagggcaggtcccacagggacgcactgcgggtacgacctggacttgtccccagggagcaggtggagggcagttcccacagggacgcactgcgggtacgacctggacttgtccccagggagcaggtggagggcagttcccacagggacgcactgcgggtacgacctggacttgtccccagggagcaggtggagggcagttcccacagggacgcactgcgggtacgacctggacgtgtccccagggagcaggtggagggcagttcccacagggatgcactgcgggtacgacctggacttgtccccaggtgccagggccaagtaagaagaaaatgtgccttccttcctattataccattttctgttttggtcttgttctcttgataatataggtagggaaacagaatcagcaattattagaaggccacctctactttgtccttaaaggagttggcaatggtttgaccagaatcaaagaagtatatattttgaagattaagagtttaaaacagtttaagaaaaaaaaaatttataggtaccatttagctttctagttgaaaaccaacacatctgcctttggggtcagaagcagctatatctaggagagggatactcctctttataaaagatgaaggagttctaaggagtttatcaggtcaaaagacattccttacattttctggatggcatcctagtaatattacaacagtagtatctaactcttgctaagtacttaacaaggtgctgggtagcagtctaagggtcccatgtccaattcagtagccatggcaactcatagttatcacataactaattatatgtggctttcagcctaaaacttcctagaaaataaaactaaaaaaattagaaacaatattataaatgcaacggaaactatacaggcaatatcctattagtgtatcaaaattttaacaaactaaacacagtattaaattgcaattttttttacttttcaataaaatacttgctaaacagtcttgtctgaaattataaattgcccaaagttaaccataaatgagtcattctattgaatttaacaaacatttaactttgcaagaaataaatttttatttttcttcattatcatacagcatttaagaataataaatctgtcttgaggtttcaaatctgagatatctatggcaagtttataaaaagtacattgatcaaggtacaatttttaacattaatatacacattccataatctcatctatttaacattaacacaggcctttgttgttgttatttttttctccctacaatatttcctgactctgtaggacagtggtcctcagttgggggttgactctgtcccctaggggcatctggcaacatccggcataactgtgggtgtcacatgagagggacgctgctcaccatcctgcaatgcacagcacagaccccaccacaggggttttatccagcccaaatgtcaacagtgtcaagtttaagcaactcttaccgagtgggactcaattcccattttatgaacacctctgtgctcactgtaattctgaaaacacagactttgctaactggtaaatactatttacaagaagattcaacctaatcaatatcacttatcaaaagcagtggctgactgtaagtatcaacatgtttccagaatgaataaaccacacaatcaactcagaatgatacaaattagggtccatatcatttaatttcccttgaacctgctctgctagtttaatctgctaatatgaaagttaattaagactgttttgaaggagcgagacaatagtttcctttgcacatttttctgaactatgagaaaaatttaatgatacataaagcacctggcaaatagcaagtcctctgcaagtgctccggaaatgtttatcacagcctactaaaaacagagtttcactcatttgttcaaatttcccataagtatgtatctgcaaagattaaattaagttttatttgctcgctctcattttacaataatctctcacaaatgtcgcttagaaacagaacacatatccagggtgtgtgatacaaaattataagttagttttttccacacaagttttaaagtatcagtgtatataatacattaatgatagtaccaaatgatagaactaaatttaatgataaattaatgatagaactaaatttaaaaggaaaaagtcattctaagtttgttaagcagataaatttttctgtaatcatttacctacatattcacattctgtatattttctcatggtcaacaaactgattcaaatgatttaagttatcccaccatttaaagagaaaagtcgctgcaataattttaaaccatggcgttatcttaatttcaccactggctgcttttttcagaagttcttttagttcttcctttgacacataacaatagcttttaatctcattgggatctggattcaaagttacattcttcctcaccaacaaaatgtaatcaatttcatgttcaccccagataccatcagactgagctttgtagtgaattcgtgttaaataattaatttcttctggaggaacctaagacattaaaaaaaaaaaagtaattaaaacatcggccaccgtaacaaaaaaaatctaaaattagctcactgtattacagcgatatctcgaacagcagtatagttttaggattagaacttggttaaagcattaatctcctatcaatggtatatggaaatcttaatattatatatggaaaaatgattacatcattagtttcaagtgtttgcgtttttttcccgatcagataagtttttttttttttaatgttaaaaaaaggggcagtcactcaaactagaaatgtgacattcttctttttcttcttttttttttttttgtgagacggagtcttgctgtcacccaagctggagtgcaatggtgtgatctcagctcactgcaacctccgcctcccaggttcaagcgattctcctgcctcagcctcctgagtagctgggattacagacgtgccgccccaccatgcccagctagtttttgtatttttagtagagacggagtttcaccatgttggtcaggctggtctcgaactcctgacctcgtgatccacctgcctcagcctcccaaagtgctgggattacaggcgtgagccaccacgaccggcccgacatttttctttttcatattttaaaattgctttttggaaaatatagataagaaatactttatttatccaggtcttatttaagggggacaattccaagaaaaaaaatgatttcaattaaaccaatgagatttatggttcatattcctaagagtttccatcagaaaatcttcaccttttttgtaggtggggagttttaggtgagaactggaaaacctgtcagttaaattctacaagagctgtaacacttgaaaatactcatcttagatttgatcaattatagaaatattcaaccttatatagtgcttaacagatcaatccatccccgtattgagctaagttttgacaagtgatattaagaaattaaaatttaaataatctttattcaagatggtttgtggggctaactcataactccggaggttaccaagcagagaactacatttgaatttaaaaattttattaaaaacctttttatagtatgtttaggtttcagcttgtatggttgtgtaggagagctggttacctcttccaagggaattcctagctcagctttcagccgtctctgtgctgctcgcctcactccaagggcgtcactttcctcaagctcggctggattgcttaatggatgactacaacacgtattcgtaaaacaacctggaaaatggtaatacagagacagatcaacttttcttcaaagtaggtctgaaagatcaagaaaaagttttataagtaactgaaaaatgaaatgatttttaaggattttaaaatcagttataatgggctatcagtaattattttaaggattttaaaattggttataatgggctatcagtaattattttaaggattttaaaattggttataatgggctatcagtaattatgttgtgaaacagactacatttgtaggtaggttccttattaatacttctttaaccaaaaaagatcaaagtgtagataatacagattaaagataaatatgtaaattatacatattgcccaattgcttactagttcttattttttcttgctgttgtattaggttgcactcattgtgtaaactcactttatgcagaatataaaattatgccattcacaggatttccctttgtgaccttggctccaagaattcagaatgataaaaagtcaaattaatgtacaaacacaatattgtacattaaaagtgtactaacctggaaaggtaatcttagcatctgatctttgctgtagcagaagcttattttcggtgttgaataagaagacactaaaagctcgatgcaataatcctgaaagcaaaagaaataacaattattttagccttaagtaccagttatttgccaaattctctccctgcagttcagaataacattagtaacttgctgctgcttttgctttttcccatggtttatccacatgcatagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggc

SEQ ID NO: 277 - DNA, 21565 bp, Homo sapiens; identical to SEQ ID NO: 276
  source 1..21565: mol_type = genomic DNA

SEQ ID NO: 278 - DNA, 21565 bp, Homo sapiens; identical to SEQ ID NO: 276
  source 1..21565: mol_type = genomic DNA

SEQ ID NO: 279 - DNA, 21565 bp, Homo sapiens; identical to SEQ ID NO: 276
  source 1..21565: mol_type = genomic DNA

SEQ ID NO: 280 - DNA, 206210 bp, Homo sapiens
  source 1..206210: mol_type = genomic DNA
gtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaataaatagttttatgtggctgggtgtggtggctcacgcctgtaatcccagcactttgggaggccgaggtggatggatcacgaggtcaagaaatcaagaccatcctggccaacatggtgaaaccccatctctactaaaaatacaaaaaattagctgggcatggtggcgggcgcctgtagtcccagctgctcaggaggttgaggcaggcgaatcacttgaacctgggaggcggaggttgcagtgagctgagattgcaccactgcactccagcctggcgacagagcgagactctgtctcaaaaaaaaaaaaacaaaaaaaaaagaaaaatattttatgtaagtagggatgtgtaagctgtagtgatcagtctttgttgcagaatggtaaatgatgcgtggatgagagaagtggggtgatgggatatttcttccctttaatgccttaatttgcatttccaaagcacctttaagcatctttttatagaactcccatgatcttctgatacctgtcttctcgcagaccccagaaagagaatacaccaattttcgtatcatctattccattgttgccgaatatttgagttgtttcaagtttggggcaattgtgaacaaagctgctatgagcattcctatacctgtcatctggtgcccatgtgcacaagtttctctaaggtatacacctaggaatgaaattgccggtttatagctagggtgaccatttgtcctggtttttgcttattttcccagcgtaactgtaacacttttagttttcaaaagtatctagggttagatgatgaattgtatggtcacctagtcataaggtatgcttgtcttcatctttactaagtaccaaactcttctaaagtattgtaccaggttacactccctccagcaatatatgaattcccttgcttctcgccctctccaatctcagcctttttagcttttatgattttagccaatatggtaaattttgcgtttacctgattagtaatcagattgcacagctcttcatatatatatatatatatatatatatatatatatatattttttttttttttttttttttttttttttttttttgagacggagttttgcttttgtcacccaggctggagtgcagtggcgtgatcttggctcactgcaacctctgcttcctgggttcaagcgattctcctgcctcagcctcctgagtagctgggattacaggtgcccactaccacaaccagctaattttttgtatttttagtagagatggggttttgccatgttgggcaggcttgtttcaaactcctgatctcagttgacccgcccgtcttggcctcccaaagtgctgggattacaggcgtgagcctctgcacccggccagctcttcatatacttttttagccatttagatagcctcatttataaagttctgttcaagtctttcccaccctgcttttaaaagttgggccttgtatcttttattgctatttagaagttctttatttactgtgaatacaagtcctttgtcatgtgtgtgtgttgcaaatactgtggcttgccttttcactctctttatggtgtcttttaatgaacagaagttcttaattttaatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatggcgtaatcttggctcactgcaacctccacctcctgggttcaagcaattttcctgcctcagcctcccaaagagctgggattacaggcatgcgccaccacgcctgctaattttttgtatttagtagagatggggtttcaccatgttggccgggctggtctcaaactcctgacctcaggtgatccacctgccttggcctgtcgaagtgctgggattataggcataagccaccaagcctggccttgtatctctattttaaaaagttttttaaaaatcacattttttggccgggcatgatggctcatgcctgtaatcccagcactttgggaggctcaggcagctggatcacaaggtcaggagctcgagaccagcctggccaacatggtaaaaccccgtctctactaaaaataaaaacaacaacaacaaacaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttgccatgttgcctgggctaagtacagtttagaaacaattgaaacatgcatgttaggaaaagttatgctcctcttgtttggataccatgaacccttgaaatggaacctgttttcctcaatgctttagatcagatcagcccatggaaaggcaaaccacctggtcctacaaattggataggaccaggtggtttgcctttccatgggctgatctaaaaggctggagtgcagtggtgtcacctcggctcactgcaacctccacctcccgggttcaagtgatgctctcacctcagccacccgagcagctgggactacaggtgcacaccaccacgcccggctaatttttgtactttttgtaaagatgaggtttctcgatgttgcccaggctggtctcgatctcctgggctcaagacatccttccgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggcgtgcactcttgcctccacttcatgtccctttactcactagttgaagaactgaagaatggatttggcactaatagcttcagagtttttaacaatagaagtttggatgggcaatttttttttttttttttttgagacagggtctcactttgttgcccaggctggaatgcagcggtgtgatcatggctcactgcagccttgacctcctaggctcaagcactcctcccacctcagggtcctggaactacaggggcgtgtgccaccatgcccagctaatttttgtatatttgataggcatgggttttgccattttgcccgggctggtctcgaactccttggctcaagcaatctacccaccttggcctcccaaagttctgggattacaagtgagagccgctatgcctggcccaaaatgatttttgagaagtacatttaaagttgtagagaagggtctttcatttaaatgcccacagggtgcatgaaaaatacaaggtgatttatcaagataggctctttggctcatgcctgtaatcccagcattttgggaggccgaggtgcatggatcacttgaggtccagagttcgagaccagcctgggcaacatggcgaaaccccatctctactaaaaatgtaaaaattagctgggcatggtggctcacgcctgtagtcccagctactcaggaggctgaggcaggagaatcgcttgaaccttggaggtggagattgcggtgagccaatattgtgccactatactccagcctgggcaacagagcaagactccatctctggaactcctgatctcaagtgatctacccaccttggcctcccagagtgctgggattataggcataagccagtgtgccctgcctttgatgatatttcaaagactaagtaacatctgaagaattttatgtcttttatttatttatttagacaacgtcttgctctgttgctcaggctggagtgcagtggcacgatcttggctcactacagcctccacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcagggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgagctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaatttttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggtaagcgcgtgtaaataaaaaaattcagctttttgaaatctagtactcctaattgttgactatgtgctgatttgtgtttagaaggtacaaagtatacttaattttggcactgaaattcagactgccctttaaaacatctccatgttttggaatgtttatctaaccatattaagcaaccatttagactgatgaagaatccctacttcatcacattaacatttttgtcttccccaaaatccctgtctacactagatatattcaccatgaatttatgatctcctcagctctttgtaaattctactttctttggcaggagaaatgagctttgttcagcagctccagccaatgtctggcaggtgctcactcttccagggaattgagcagctgtacatatctcctcaatacacaaccacctgtgtttccatccacttcttggcagtgtggataatccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccgttaagctgagtcagtttcaccttgaggagaccatgcctttctcacaggttactgtctgtctgcagggcttttcacgtttctcctttatgctcttccctccacttgcacacttctgttgtctgctgcattttctcctctgtgacccattgtggtgtgcattggtgctcattcctaggtgcttgaaacaagcctaccttgtacagcaaacgtgatgtcctctttctctggaatatagtttcacttctggattttctttttctgaattgttcaggctgaaacttattattctgccttacagttctctttatttctggcctgcagtgtcttgccatcctattaaataaagggaaggttgtaggtttctcacatggaccaggctccttctcagacaggtctgggcccactagtttttccccaagactgatcagagaacatgggaaactccagttgtgtcttatgatttttttaaagctttctctttttctatcagctctttcggtaagcttggaggaagaagggtattgttgctgggaagattaggtgatatattagttcttactaaaagctaggcacttttgacatttcaagctggttagttctttgttgtaggggctatgctatacagcgtaggatgtttagcagcatctctggcctctgctaattggatgccagtagcaccaccaccccttccagttgtgccaaccaaaaatgtctccagacgtagccaaacatcccctgggggcgcagaatcacccccagtaagaaccagtgggctagaaggaaggctgaatgcacgttgcctgaccttcctgttggtatgctatcctgccagccccagccagctgaggtgacagagctgctcacagttgaagcttagctaatgtcacaagttcagctttcctattggctccttccttgatgccttagatcttttcttccaaccaaaacattgtttctcaaagctcaaaacacattgttggccttaagtaattatttcataaatcagcatgagtcagcactgggattgaagctctcataaatccatggaacgtcttctcatgggcaagggaatcagtcttgttaggatggtaagaatgggctgttctttcagggcaggtgcttttggaccatccagagatgagaggggagacatcagaagcatgtatgtaaaattcacttatacgaataaggagttggatttgataagtaccgaggtccctattctagaatctgagttaatagagtataacatttgggcaacttttctcctagcagtttcttacaaaacttataaaataaaggaggaataatcacacattacgattttctggccttccctttctttattcctcttacacttttcacaaccaatcagaattttcttcagcactgtcatctctgtatttttctggttcacagttatgtatatctccatctttcctttttgtaatatactaccatttccaaaagggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatcactttctctgtaagtattcccaacatagatattttatcttttccaattatatttaagatgatgcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacgcgtgtaatcccaggactttgggaggccggggtgggcggatcatgaggtcgagagatagagaccatcctggccaacatggtgaaaccccatctctactaaaaatgcaagaaattagctgggcctggtggtgcacgcctgtagtcccagctacttgggaggctgaggcaggagaattgcttgaacctgggaggtggaggttgcagtgagccgagatcgcgccactgcactccagcctggcaacagagggagactccatctcaaaaacaaaacaaaacaaaacaaaacaagaacaaagaaagcctaagtatctctggctgttagagtggggaaaacaatcgacatattgaggggacggatatagcttgtcctttttactggttcagagcagttcactcacattcttctgctcaaaggcttctaagaaacaataactcctttgcaataaaggaaaactgagtttggagatgtttaccaggtaatgaccttaacttttctgaggtacctaggaaatagttaaatgtaccaggatggtacataaatagagacaataattatgagacttttagatagaaggtccaaactctcttatttatgatatttttttatattaggtgatacatgaattttaatgaatctgctcttgcacaatgtaaatgggatgctttatagaagtgccattttaatgaagtttcaaaagatagaatatatgtgaaggtacttgcaaactatagctatcctaaatttaagaatcaacccaaagatcataaacaaaaataagtaacagcattcatggaaaactgtctcagtgttttaatccacatatttggtaaagctttaaaatgaaaaagaagaaagttaatttgcacattacaaattcaaaagatgatagagaattaacactgaataaaacaataaataggaaatctatatgattaataaataaaacaccttaccttttatgtaggtttgtcaagatcattcttctccagaaacttaaaaagaatagtggttgcgtccttgctgttagaaaatggtgtttctttcattgtctgtggatttaaacataggcttaacggtgcccaccttcctcgtgctgcactgaccatcccactcctgggtcttgtgttggctgctgagtagcagccatgtgtagagttggtggtgattcttgaagtttgaatttctgcctctcttcctgccagggtacccaaaattttactcagaactagctcaacttttctcatagtttcttctatagcatggcagcagctgctgttatttcctactattctggaatactaatatgccttggcagtatagtgaaacaaaaattaatctaaaaaataagcatgttaaaagactagatgaggccgggtgcggtggctcacgcctgtaatcccagcactttgggaggccgaggtgggcagatcatgaggtcaagagatcgagagaccatcctggccaacatggtgaaaccccgtctgtactaagaatacaaaaattagctgggcattgtggcaccctgtaatcccagctactctggaggccgagacaggagaatcccttgaacccaggaggcggaggttgcagtgagctgagattgcaccactgcactccagcctggcaacagcaagactccatctcaaaaaaaaaaagactagatgaaactaaaccatattctcatgtgtcagctggaatctagaggactctggccctttggggctattcttgaaccacattctagaggttattagaactacagttcaaggatagccagagaagggctggaatgacctggaaaggttcagtgcaaattgttacatgcatatgactttccaagcacataatagatggctgtaaacagaaaggaaagaaggattagttattttattcatagcttagaatttagctgtagtaacatgttaagctgcacggaggggaagaaggatcactactatgttggatctcaaaaaactccgaaaggtggaaatggttctggacaaagcaaggaatggtatcaaggatgaattctcttaacccagagtacatttctttttagagagagtgacccatttgtctaactttgcaaaacagacgaattacttgaacctttgccattgatgtgcacatccagtgagggacaattcatcttcttagaaaaactgacacacattgcttcatcctcattttttagaggctccatagacaactacaaatgtgcaaaagttgggagtacatctttttcacaaagaaatcttcaattctgccctgtagggttttttccacaaccatctcctgtgatctttcaaattggttcattaaagatctgggtgttctgaagtaattctttggtgtggtctgtaccatttgtggtcagtcttatttgtggtttatatttggccagagcatccacgacctcaaaagccttttccagatctctgtgtaggttttggcaacttctttgtactctgaataaaaaaatactgccctgatgccacatcccatgaaagttgcaaattcttctttaactgtaagagctgtttcttaccatgttctacccagtcttcctcctggtttcaaactgttcgtaatattttggtctaacctttgtttggaggctttagggtttcttgttgttgtctttttgtttcattttattttgttttcctggtttgaaatgcagattatttctctagctttttacattgactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagctacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaaggagggccaccttaccaaatgcagtgtaccatttttatttttatagagtcctagctgtaatcatttctgagggcaaaaccatttatcttgttctctagttttgtgtggctaccattcataagtagttcataaatatagtttctggtatgcatagcagccattcaagccttaaatgtttggtcatatctatatgcctacagaataaggcaaactccttagctcaatatttaacgtcttccaacatctagttccagcctgtcctttaggctttttcatctactaatctcctttttctcaaatagtctgagcatggtcctatacctctatttttttgtctattcagtcccttccttgaaatgatcacctcgtcctttcctagactccgtctgttcaaaatcctgcccattgttaagagccagctcaagaatctctgctttttgatcccacctcctggaattttatctcatacctttattttatcttataccatattctatatggtatcacacttacactctgttcacccttttatgataattattgatggaggtttcatacttccaacttctctgtatccactaggacagtttcctttataataatatgtattagatgatataaattaaattttattgatataaactaaatttccaaattgatatatggttgctgtccacaatcattgtctacctaaaattaaaaaggaactggtacttactaggtaaaagttcaagctctaaattcagtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgagttaagaagtgcagtgaaagatttgaataaagttgaagagactggtgttattccctcagagaaggggaaactaggggaagaattttatagcactcaaagaaaatgggaactggtgtaaacccaatagaaattcagtttaaaaccaaaagaatttcttggctataaaagttttaaggaagatagagtaggctgctgaagaaattaatagcaccttctcttggaagttacttaaagtaatagtagataaatatctttccaaaatgattgaaatccagcctttgaaggtagggatgagtcacatgacctctcatgatcatttttgatctcataatttggagcccaggatagaaagctaactagggttacaggttttctaaaatctgctctggttttttaaaggactttttaatggttaaatttattttatttctatttggtaaatgagcctggggccttttggtcagggatgtattttcagtaagtcaaatgaggttgtaaatcaggtagatctttataattgccagtttagtaagctgaaacacgatacgagcagggagaaagatatagccgcccacttgcacacttgatcacagacatgggtggaatgtgatgcactgtgtgtatatacatgctcctagacttacagtggggctgtgggctgataaacccatcataaagtgaaaatatcataaattaaaaatacatttaatacacctaatctaccaaccatcatagcttagcctggactttaaatgtgctcagaacacttacattaccctacagttgggcagaatcatccaacacaaagccaattctataataaagtgttgaatatctcatgtaagagtgttgtaccacatatcgctagcccaggaaacgatcaagtatggtttttactgatcataccatagtaaagttgaaccaagttgtaagttgtaagttgaaccagttgtaagccaaggactgtctgtataaagaactgcaaatgcagggctttgaacactgttcttcagggcagcagagtgaggtggaatggtcatccatgggaccatgtgctgcttgcagagtaagtcatttgtatatcacttcctagaccagcttctctgggatttgtcagagcaaggctccccaggaggccatttgcagagtttggccagagtgagtaaagggcaccaactcccaatctggttataaactccctagtgggttttatgactctttgcccacaattggaatgggtggaggagagagtgactatcgtggattggttgagaacgcattccttcctcttggattctaggattccctttctcagtcagaaaatttgaaagtcttccccatctctgtctgtaaagtctttctatctctctctccctccgtccccaccagacatctcagaacttcagagaactcccttgcccacaaaacatttgcagttcctacttcagagcctcacaccgtcaaggcaaggagctcttcttctcccagccactgctgagcactgggggcccagagtgctccctcccaagccctggactgcttctgctgctggggctgcccagcaatgccttatccatctcactatttttttctttaattttgaaataatttcagacttagagaaaagctctaagaataataccaaaatttcccgtacattgttgcacatgttcacattttatcacatctgttttctgctctattattctcaatctctccctttgtttctcttctctctcatattttcttttcagaatcatttgagagtaagttgaagatgtgttgcacctttacccctaaatattgcagtttttctacaaagatgctctcatatatagccacaatacaaattattaaaatcaagatattaaagtaatttatgcacatttgttcaaattttaaattttgcgagattatactgatgttctttctggaggaaaagaaaaatctcctactccaggatcacatggagtatgtaattatgtccctggggcctcctttaatctggaatagtacctgcttttttgttttgttttgctttgcttcgtgttttccatgattttgatattttttaagcatacaggccatttattttgtatggtgtgcctcaatttgggcttatctgatgtttcctcatgattagatttaggctgtacattttttggcaggaataccatagaagtgaccgtatgtccttcccagtgcatttcatcaggatcatatgataatacatttgtctcatcactgggttaaggtggtaactgccaggcttcttcactgtgaaattaccatttttcgctttgtaatcagtaagcatctggtgagaagatactttgggattatataaatatcaattctcatccaattttcacctcctagttttaccattcacttatggctcttatctaaaataattattactatgataattaccaaatggtaattttctaattccattctttctacaacttactaattggcattctagaaggaagaattatttcttcttccccatttatttaatttttttgtataattgtgggttttaattttattctataggttataacctgtcattaccatgattgattttgatgttccccaaacatcaaattgtcccagatttatttatcagcaaatgtttcaagtgggttcttgtgccttttccacatgcttccatcctgtggattcttccttcctttctgccacagcatgatgttccaggtttagcttatccttttcttaagccagccctggaatcatccatttctcccaagccttggttccttatggtggagaacagtagttaggaaccaggatctgggctgggtgaggtggctcatgcctgtaatcccagcactttgggaggccgagacaggcggatctcttgaggccaggagttcaagaccagcctggccaacacggtgaaaccctgtctctacaaaaaaaaaacacaaaaatgagccgggcttggtggcaggcgcctgtagtcccagctacttgggaggctgaggcagagaattgcttgaacccgggaggtggaggttgcagtgagctgagattgcaccgagctgagattgcaccactgcactccagtctgggtgaaaaagcaagacttcatctgttaaaaaaaaaaaaaaaaatggaggaaaccaagttctgatcacttaaatgtgcccattgctgcttgggtgtcactgcttctagccctctcagaggacagagctaggatagcatgcatatttatatccatgtatgtgcacatatacatatgggtgttataaacacatatgcgtgtacacacacactcccttcatgagttcagaccattccagatctgcgccaccatacggttgtattctgtctttccctcttcccatgtaattcctttctctgacagtgagaaccctgacttccattacccacaatatacttatgtgctacaccctagaatacacagtaagtagtttcagaattactaactcatgccattgtgaaaaacaaacctcttaagtggaggtcaatatttatatatggttccttttggctttaccccaagtgtatttagtcaaaacactgtgtttaaatgttactagagttagtttttctcccccttcagtgttactgtagtattcattggaatacaattaggcttatttgtttctgtttgttttttattttatacttgttacctttttaaattagaatgtaaaacattaacatgattttaaaaatggaaactgtattaaagggtattctcagtgaatgtgccctctctacccattcccattccctcatcctttcctgcaggtctccaatctcattagcttgtagtttatccttcctgtttctttgtgtacaaatgagcagatagatgtgcatttttctaatttctcctcctttctaacacaaaatgtagcatactataggtagtcttttgcattttgatttttccagtatatcctggaaatgacttcatagagatttcttttctttgacagctgcactctactccgttgcatgcatgtatacagtttgcttacctgctttcctatgtatgggtttataggttgtttccaatattttgcagtttaaaaagtagtgtcatgagtaatcttgggcatattttgactgatagatacttaggtagcagttattgtatattagatatcctttcagttgttaggactctgtttggctaggtaataagtgagcagataatgaattgtcttttactcgggcctgcagagccagaaccctggctgatgggcaggatacaaaacccgttctcctgggctctgacccaggagagaccgagggaacaccaactgattcagcagtaggtgagagaaccaagtgccagatggtggtgagggaggtggcaccatcactcacatgtgtgtttgtgtatatgcatttatctgatgccaaactggaggataaaggaagatgcgaagagtcatgtccttcattttttacctctttactttaaccttattgattgggataccacactctacattctgctaaacatcagcaaccaaaagggaagaagacatagctcttgctgggctgtcaagttcactgacaaatcaacaaatgttgcatagtattttggacagtatgccttgagagctcataagaagttgaaatgaaaacattctaggcagaggggagcagcatattcacaagcatgactgcgtgaggaagcatgttacatacctgggtaactacagcagaaactccaggtagattaaagacttgattaccaaaaaacagacacacagaaacacttaaaaagctagaggagaggtggggtgcggtggctcacgcctgtaatcccagcactgtgggaggccgaggcaggcagatcacgaggtcaggagatcgagaccatcctggctaacatggtgaaaccccgtctctactaaaaatgcaaaaattagctgggtgtggtggcacacacctgtagtcccagctactcgggaggctgaggcaggagaatcacttgaacctgggaggcggagcttgcagtgagctgagatcgcaccactgcactccagcctgggcgacagagcgagactcggtctcaaaaaaaaaaaaaaaaaaaaagctagaggagagattatgtataattatttatctgatctttggatggtcaaggacatcataaccatcaaagcaatgaaagaatatgcagatagacttgactatataaaaatatagaacttctatctagtaaaaagtattaatatttaaagcaaacataatgagaaagatgtttgatgtttacaacatatgtgctaggcaaagtttaatatctatagtgtttaaataaatatatatatacttttaagtttggtagcattaaaacaaaaaccctaatagagaaatgggcagaggatcagctatggtggctcatacctgtaatcccagcactctggcaggccgagacaggagactcacttgagcccaggagttcaacaccagcctgggcaacacaaggagaccatctctctctctttctctctctctctctccccctgttctccccacccccccattcccctccttctctcgtctctcaataaatacataaacaaataggcagaggacaggaacacagaatgtacagaaaaggaaaatcactggtggccacgacattgctgacatttactgagtgagtaacatgtgccaacccctttcctaagagtcctgcatttattgattgattcattcagtcctcacggcaacagttgagatatgtgcttttagccccattctatgggtgttgaaattgaggcacagttacacaaataagttgcacagctgcaaattgaacccaagcactttaactgttagccactccactccgaagtctcttaggtataatggctaattcaaatatgaaaaaaaaattgttggtggtttaaaaatgcaaatttagtaactgcaagattacaattttttgcctaccacactaacaaagagtttacaacttacccaaatctaactaagctggtggaaaatggacaccttatttacactgaagaaagtgtatattggtaggcattttctggaactttgacagtgtgtatcaaaaacatctaatggtttttttttttaataaaattttatgtatttaaaaactaggctggggacagtggctcacgcctgtaatcccagcactttgggaagccaaggcaagcagatcacctgaggtcaggagttcgagaccagcctggccaacatgacgaaaccctgtctctactaaaaatacagaaaatagccgggcgtggtgatgggtgcctgtaatcccagctactcgggaggctaaggcaggagaatcacttgaacctgagcggcggaggttgcagtgagctgagattgtgccattgcactccaaccaggtgacagagtgagactccatctcaaaaagtaatacataaaacaaaaaatagagacagggtcttgctatgttgcccaggctggtctcaaattatggagctcaagcatttctcctgccttggcctcccaagtgtgggattcaggtgtgagccaccgtgcccagcctccaatggttattttctaaaggaattcattctagggaaatcagcatattttaatcaacaaacattattttcatagttaatatagcaacattattttgtttcatattattatgttttaaatagtggacttctctttttgcctccctcccccagcccctgattatagcaatatggactcatagtagaaagttaaaaaaaaaggtgtaattaatagaagaaaatgtcacccagagagttaatgttttggtatatttgtccttcacactcattatttacaacaggtaaaaaactaaaacagacttgatatttcaaaggcaagagagaaccattcccacgagaaagttatggcacatccatataatggaatattattagctgctgagaattatgttctgaccaggtgcagtggctcatgcctgtaatctttgggagactgaggcaggaggatcacatgagcccaggagttcgaggccagcctgggcaacatagtaagaccccatctctacaaaaataaataaatgaaattagctgggcctggtagcttgtgactgtaattccagttactcaggaggctgagtcctccattaaggatggcttgatcccaggaggtcaaggcttcagtgaactatgattgcaccactgcactccaacctgggcaatagaaccagaccctgtttcttaaaaaaaattatctgggaatttgtaatgcttgtgataagcaagtggctttcaaaattatatatgtaatatgttctcaattatgtaaaaaatatgcaaagcaaaacaaatacatttctagatgacctctggaattagaattacagatactttttattttcttatttatactttttgctgtaactaaaaagaaaagaggccagagtcaatggaggcctgacagtgaggatgcatggaaaagaggcaggtcctgttcgttccgtagcaggagcatgcctggtgcagagtggtgctcagaaaatactggtatttattgaatgcataactgagcttggagagatagtgagcgcagctttatgtagctttcactgtgcgtttggatgtctacgtgcactttgcacagactccagagctcagcagggggtctgcattagagggagcagctgggagtcgtggacatgcggtggtagctgaaaccatggatgtgggtgagggcaaccagggggaagtgtatagggaaacagggctgagggtggagtgcttggagtgttaacatctaagggactaataaagaatgaggagctcgccaaggaaatttgcaaagggcccagaagtcagaagaaaattgggagataatggtgttaggaaaaccagaagaggtcagtatttcaacagtaacagtcacaataatcatcatagctgccacttctagagcccttgctatgtgtcaggcactgttaccggaattacacacatttactcacttagtcctcacggagaccctatggggtaggttactgtgaccatctctcttctgggacgagacactaagagacttgtctaagatcatcccccagagattcagtgccccagagagaaagtcataagaagtattctttggacaactgtatattaagtgcgattaaaagtagattcaaaaagcttttgactgttttattctgtttggttgggcgtagcgtctcacgcctgtaatcccagcactttgggagtctgaggtaggtggaccacttgaggtcaggagttcaagaccagcctggccaacatggtgaaaccccatttctactaaaaatacaaaaatatggatgtggtggcatgtgcctgtagtcccagctactcaagaggctgagataggagaatcacttgaacctgggaagcagaggttgcagtgagctgagatcaccccactgcactccagcctgggcgacagagcaagactctgtctttttttttttttctttttttaaaacaaagcaaaacaaaacaaaacaaaagcttgactgtcaagggctggggacacaggaacctagttgtctttatttttaagctggagagcctggagcatgtgtatgtacatcagtagggaaaagaaagagcagcgctgatggaaaaaatcgaggggaaaacaaaaagcaacatccaggcaggtggtttattacaaagtctgatctggcatttgatgaaattcaacattctctcctaactaaaatacttaaacctactaactagaactataagggttctaaatctcagattaactttttcttttttatcgggggcagacggacgtgtaactaacgctataaagggtaaaggacagctggatccaagtctacagacttacgtctatagtttttagagaccagataaacttgccattaatattaattaatggcaagttcgtcagttaagttaaatatcagttaattgtacattcaggcatttctaaaattagtatgtttgtggaataatcataaaaatgtgtcagcagtttcaatttttggctttctttattcagtattaaaatattgggcagtccttcatggaacaaggctgtaactataggaagcagaagtgattgaatgaattaggcattcacttcggggaattccctttgctggctcttcatatgttgagggtttcaccttagcttttgtgaggtccgtgtgctatttaaaaactgagtctataattaatcagcgctgctagaagatggtgcaaatggcccagttttgtgcctccaggttatgaatttggctcttgtcttcagtgtggtttgcagcgtccttctacatgtccccttttttagaaatgatactcccctccacccctgccccccacacacatatacagccaaccggatttaaggaaagcaggaactacaataaacttttgaggaaagatgctttagggtatgatttagtaccttagttcctttctcacttgagtattaatcagtgtggttttctgcaccgtcgttctttcctcctctggtttaatgacagagatttcttctttaggtgccacaaccacccacgtccgtagagatccccgggcttgtttctcctttagcctctgaatagttcttggctgatttcttgaggaagcaccgcattggaagagaaaagcatcttctctttggtttcctgctccctgcttctctgcccttttaagtccataaagcgaattaggaagaaagccacatacttcatttctacccaggggggtatcatgtcaggaggctaatcatatccactctctcagagagaaagctgcttcttcccagaatcttagatgcaagctactggtttaaatgttgtattatatgatggctaaatacagaagtacgtgtcatagtagttcaggttgccagctactactagttttcacagtctgccttcagtgggctattttgtttaaaagagcttccacttacaagcttttcaaaatacaatttaagtgaaacttaagagtgtttttaagtagagactaagtggtttcatcctacctgaaaattgccttcttgaaataaatgtttgatacccactggcctatctcctctggaaaacaggagttttcatttagaagtccagttggttggattccagtaagccgtttcacctgactgtattacgccccctggaaccagggctgtgcaggagccaccggcttctcccagagggcagggtgagcacagtatcagggcacatggcttaccctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggcactaaccaaaaaaaaaaaacaacaacaaactaggctaagcaagtgcagagtcatttataaacttgcataggtcttttatatacagtcatttatcatttaaaaactgagattcattttgagaaatgcaccattaggcaacttcattgtcgtgtgaacatcatagtgtatgtacttagacagacctaagtcgaagtctataggttactacacacctaggctatgtggcatagctgattgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctctttgctgcattctgatcttctagaagagcctggcgcttagtaggttcttattaattgttgaacaaatgttaaattaattatgacgggaagaacttttaaaatgtgctttcccttctagtgtgtgattcttagggacaattttattttattagaacataaaccatcagcactggtttacttacttccaaatgatgctaggtatgccctgtcttctttcgaggtctggtacttttgctgaaatgcagcctctatcttaagatcatttcagttgcatcagaaagaagatgtcactgcctgctctaaaccttgggcggagaaagcagagctgtgacataatccacatttgtacatagcaggttgaagagacacttaaatcttttgcttactttttctcttatcagataattcatttcttgattgcatttatttttgaaaggaaaataccagctttagccataagaagctgtcaagaaagcttctctttgcttagccttcccagcagctacgctcctgggtgagtgcagtcaaggcaatcattaaagaataataagttatgcttttgaaatggtgctcaagtacttcatagccttttctaagataaggagcctcccacctttgcccccatgacacttgttggaaaatactggaccagcagctatatccttgggcttttgctgggttttggaagacacattttgacctatgtaatcaagtataatgatgacatttattttaataggattctagtctgtaatataataaggaaaatggctatttttccttattttctcattataatatgttacactaaaagcttctgccattactgttttattatattggtctgaggtacaatatattttaatatgctaaagataacatcaaggttgaaaattgagctctcagtgatttattcagaggttgactgttgctgaatgcattgaaatgagttgcatgagacagtgcggctaacgatttatttgtgtatctttttttaagctaagcttgtcataaataagagcaaataaatagctcttatagaatagtttgtattcattgcctcaatgaaaacattgtaaatatgaaacatacggtctgcagtctctctcattttttctgaaagctagtgttttgccttacatagctcagaattttttcaagttttggcatgcaggtggttggttttttttttttaccaaacaaattttttgtctgtttggatttctaacgttgactggcatttgcattgagttattttgaaatccactactggacaaattccattcaaataattggtatgagaataacctaatcttcagcagaactggaacaaaatgaaaccttagtgggaccatcaagagggcaggaacttggtcattgctaaactccaagccatgagcacagtgcctagcacatagaggatacagaataaaggattgttgggggaaatcaatgaatgcctgagtctagttaatccacttctttgtatgactgtcaacacctgccagatgcatccagctagcttttgaccagtagtgcttaaactcagatctcctctcagtctttgttttttacactttatttatcccttcatcccatccttcagcaaacatgctttaaatacactgtgccagggatggtctaggtgatgaggacataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggccatttttcagggggaggggtggggggtcagctagagacaggctcttgctttgttgcccaggctggtttccaactcctggcttcaagttatgctcctgcctcggcctcccaaggcactgggattacaggtgtgagccactatgccctgagctgttgttaaaacaagatcaagaaagattttgctctgcttggttgaaattagtgctatacctcatttgggtttcaagagaactattcccccttgaacatatattccagcttgtaatagagacattatgtttgagatagaatattctaagataaaagtttgcttccacttacccctctcatgatggcatttcgtttttttgttctttttttttttttcttttgagaccgagtcttgctctgttgcccaggctgaagtgcagtggcacgatctcagctcactgcagcctctgcctcccgggttcaagcagttctcctgcctcagtctcctgagtagctgggatcacaggcacgtgccaccatgcccgggtaatttttgtatttttagtagagacagggttttgccatgttgcccaggctggtctcaaactcctgaatacaagcgatccacccacctcagcctcccaaagtgctgggattacaggcatgagccaccacgcctggccctaaacaacacaactataacttcagctggttgtaaggtagttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtggttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataataaagataaaaaattgcaatttattgcaacttgtcaaatgtttaaattcacaagttcataatgatactaaaaaacaaactgatttagaggataataggaaccagtttattttcttgaaagctgcaaaaattgcaattaaaacatttatcctgcctttcttacataaactgtacagtgaagtaatcaagtagtaaaggaggggaaacatcattttattttttaaatttttaaaaattttttgagacagggtcttgctctatcacccaggctgtagtgcagtggtgcgatctcagcttactgcagcctcacctcctagactcaagagatcctcccacctcagcctcctgagtaactgggacttcaggtaaacaccaccatgcccagctgattttttcattttctgtagtctctttatgttgtccaggctggtcttgaactcctgcgctcaagcgatccatctgccttggcttcccaacgtgataggattacaggcatgagccactgcacctggccagaaacatctttttataaacatattccagctaaccaatgaaaataaaatgtacggtggctcacacctgtaatcccagcactttgggaggccgaggcaggcggattgcctgagctcagggagttcacgaccagcctggacaacatggtgaaactccatctctactaaaatacaaaaaattatccgggtgttgcggcatgcacctgtagtcccagctacttgggaggctgaggcaggagcatcccttgaacccgggaggcggaggttgcagtgagctgagatcgtgccactgtactccagcctgggcaacagagtgagactccatctcaaaaaaaaaaaaaaaagaaaagaaaatgacagaattaaaatataaccattttgtaatccccaccaccaccatgaattaatggatctagacaatgaacaacatcaacagttgcaaaaaggacaaccagaaattatctatcttctgatcaaggatatttgtagtcttgccagtggatggaacccaagtctaatcaatcaagcactggatctagttaccattttgcaagagatacagagtaaagaggagcatactgagctgcagtgcaagtaggagatcagcaaaatccagagtgaggacagtataggtcaagtggccccagttcaaccacagatagattacaaggaaaagaaaggggtgaaggtggaacccctagattaaaatgacattaagatttttttttttaataggcaagactgttctagtgcctggactgttttggtgatgaaagtataaaaaaatgcaagagattattgtgaaagtcaggatagtggttacttatgagagagaaaggagaggtgattggctggagcggatagaaagttttctggagtagccggcaaacttctatttcttgatcctgggtgatagttacaaggacagttgccttataataatccattaagctgtgtatttgttttttgtcattttatgtatctctgttttatttttgttttttagaaagcaatcatcttaaaatgggaggtgacatcctatggtatcttagtgcttgggtttttgtaactcttgaaactgaaaacttactcgatttattggtggcatcctactagtcatgttttaaagagagacacagttttcaccttgactgcttgaaaatgaaaacttgagtgcacaagtatttagtgtacgggcatcaactccatgtcagcctttgcagagccatttttatgtgaaggaaatgtactgaaatttacttgaatcaaatcctctgaagtgttgagtctagttcattagagaacagcattcctgtaaatttcactttcactcttaaacttagaaaaacataattgaagggttgtgcgttaacagaatgaggatgaaatggaggattcggacaaggaatggtgatgcagagtgaggatggagtacagagaaaatatttaactgtgagcccgaggagagaaagaagagacactgcagcatgagaactgttttcccatttttctttttttgtgggaagaacagcaccagcagacactgtaagatgtgtacaggaaaattgctctttcctcctcctaggttgctgagcagttctaaaatttgtggtagatctttaggcactagaaacagaacttagagaaaagatgttaaaagttagatttttaagaaagggaagaaaaaggctacgatgacttaaaatgtcctgaaatgaggctctgctatttatcagaaaaacaggcttccttcttcttaagaaggtgattgtctgttcatagactaggagtcctgccctggggttcacccagcgttggagcttttctccatgaagttaaggacattaataagatttttctctaccaaagcagaagatgctctgaagacagcctttcatccctgtagcttttgagttgcatccagttaaaaacttgtagaacataatgaatgtttttagagaggaaataaaatgaatgatgcccgtgaatttgttttaaacattgtttattttacctaataatttatataaatcttccttgaagaggaagagaaattaccagatttaattaataattggaagctttttagaggatttactttgaaatacctccctgccaatttttcataaattaagcataaactttctttgacctcatcacacataattaaatagctgtggaagggttaaaaccaactaaaaagcaattctgtatctcaatctccattctcctgcaaaacttatacaggaagtttgtttcagttctcaagcagggtaattacaagagacagttacataatttacacttccaatctacttgtctataatcacacacttctacctagttgtatatacccccatgagtatgtgtgttgtactttgatttgtaaatgatgattgcagtgtgattgattccttgcaatgtagcatattgaattcattttttaaaaatgaactttagctgttaacatgtctatttgagttcctgttatttacgtagtttgtggttcttgtgttcagcagttgcataccagctaacaaattaaactcccagagctttttttctcattaaatttggaaaatagagtgtctgtatacaacctaaatagaaaagtacctagtacctagtaggcactcaactgttggacatagcacaaaaccatttcaagcctttgcaggtggaatggagattctttgattaacataatataaagtctcatggggataatattagtatattgtggtgaagctctgctaatattaatgtattgttactgaagtctaaaatttagccaaacagtggacagaatagcggttcattccaggggcttagagaaatgtgtcatctacaacctaagaggtagtcattgctgtctttaatgctgctggtgacgatactgcatatgtgtttgtttttctaacagctaacatctactgtagccagtttggactttaagattccctaagattaaaggctaagtccctggccgggcgcagtggctcatgcctgtaatctcagcactttgggaggctggggcaggcagatcacctgaggtcaggagttcgagaccagcctaacatgaagcaacccgatctctactaaaaatacaaaattacccaggcgtggtggtgcatgcctgtaatcccagctactcgggaggctgaggcaggagaatcacttgaacccgggagatggtggttgcaatgagccgagatcatgccattgcactccagcctgggcaacaagagtgaaactccatctcaaattaaaaaagctaagtccctacatgacaccaagtccatgggcaaaccagccagtcacttgtctggcccccctcccaccctagctccgctacccagggtgcctttgtgctgcacagcttcagagggggctcagcaataaccctggggggacacaaccattgatctccagaggcttcttacctcaaatcacgtttcaaagcatttgggagataaataaaaaataagcgaaaagaaaagtagaccagtggagtgggattgtttgtctagataacctgaggacaactagcgacagtttctcttacatttccaacagtggttgatcagtcagattaggtgatgggctgtactttgattttagaaagttatctccaaaactgacagattcctttttgaaatgtactttgtttgaaaacaaagaaaatttctaaggagatttgtattctcattttttctttcttcaatcttgctgtgtatttttgtttgctgtgtgaaagctcatcatccagaattggaattacaacatactttgtcctatttttaaaaattacagctggtacatacacacaacactcccttccacatatacacacagcattttagggggcttgtaggagagcaaatggaaaggcaagttgctattccaaccatcctgtctcccaaacctggttctgaaatcagtggtactgccatgattatgtaaatagcacccctctcccaccctccaccatcggtctgtggggttggaccagaccagatgactagatattagaatgaagtgtctcagctgcctcagtagaacctcagacctataaaagtaggcaaaagaagtctcagtttttgcatttagtgatttagttaaggaaaatgttcaatcgcagtgttttcgcagcaggagaacaatcttaaaggtaaagcattttaagtgcatgcagtcatttgtttggcgcagatgctttatttaaagtgtatatgtgttcgattaagtttgccatcttaaagcctttcagtggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcaatgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaaccactgggctatacttgaagacagaagaaggaacaataggccaggtgcaatggctcacacctgtaatcccagcactttgggaggccgaggcaggagggttgcttgagccgaggagtttgagaccagcctgggcaacatggtgaaaccccatctctacaaaaatacaaacattagccaagcatggtggtatgcacttgttgtcccagctactcgggaggctgaggtgggaggatttcttgagcccagaaagttgaggctgcagtgaaccaagatcacaccactgcactccagcctgggtgatagagtgagaccgtgtccaaaaaataaaagaaaaaggagcaattaattctctcactgggtaagagaatcaggtataaatgccatctcacacagatgtctctggccctcaggctgcttccatgtggcacgtgctatcctggcacctccggctcaggagcacatccacagaggtctacgcttctcaacacaggggcggtgcagagggagggaagtcccctttcgtgctgcctgatgccctacttgtgagttcattttctttctgagcacctgtacctttccctgggggactgacatgcagaatgaccaaccccgcaagggagtccacacctacccacagaaccatggaaccatctggtaaatcccagcatggtcagtcagctcagagacacaggcacaccacacggcatcggggagtcacactcctgccatacatcttccactgtgggagttgaaggaagaccattccactctggaatggacttgaaaggatggggacattcagtaagaaaaatcagtggccctttggggaagagctcagcagtggaggtctgctgaggaacttgtgggatcccagagaagagagatctaagagtggggcttagagtaacaggctggtatgtgacccagggcagccagcctccttccccaaagacatgctgtgtccatgctcagggtttcactgggtcaggccattttcccagagacacacttgagtcttgttgaatatttgagtctttcatctgtcttgggactgtccctgggctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttgattcattcagtatgttgaataataatcatagctaacacttattaggattactgtgatgcgtcaagcactgttctgcatgtttcatattaactcaatccttaccagaactgtaacagttaggtacagttattattcacatcttatggatgagggatctgaagcacagagaggttaaataaaatccctgaggtcacacagctggtacatggtggaccccagattccattctgggtagtctggctccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagccagaagttaaagagatttgtaaaacatgtaaaataatgccactcttttcactataaattttatttatattttagaaagtataggattttttttaatttaaaaaaatgttacataatgggtttatcgttatcttttagatgaattaataaatatttgtcaaatttctcagtaaaattaatagatagagcccttaaaagcaaaagctctctgagtgctgaggccaaagcatttgaaaactaccgatttaaagtataaaccattgctattcaagtgtggtccatggcacaggaagttgttagaggtgcagaatctcaagccccacccctgacctactgaaccggagtccatgctgttaaccagaactagtttgtctgcacaatggaagttgagaagcagaggtgtagaacatctgcacgaagcgatttggcaactcagtgacctctagccaaatttcagtctggtggggctttggcgagtccattctccaattatcttgcatccaaggagctgagtgaggtcttacctatttgagattcttcagtcctactgtctcttaagtggccacaccctcatcaaagccagcagcttcagagcagggttctagtggtggttttcaaactcgggtacatcagaatcacctgggggacttctgaaagcacagatgctgggctctgcctctccccaccaaagatcctgattcagcaggtctgagataggttctgagaatttaaagttctagcaagttctcaggtgatgttgatgccacaggtctccacactgagatcttgataaacagcatttattcaagttcttatataattatgtcatgcccataggacttatgggagagaggtcttaaacttgtttcaacaccaatctcttaaaagtaaaatatatgaaaaattcaaaatttccgtctttgccaaggaggcacctgtatcttttaataagtggaaagcagtaagatatcaggcaggtcacaggtcatttagagcacggctgttctcttaaaatgatgtgagaactaaggttcagcatccttctgcactaattgcaaaatcaccacaaaatttaaacgaggagatataaatagcctgtcaagttcatttgtcattatttaaactgataacatgccattcatccagttggtcagtgctgctctgcaccagaaaccaggaacagatgagcgtacaaaccagtgaattgccatctccaagcatgagataacttggttagagtcatcagatttcctgtgctcaaaagctgccataaatccctggcctcgtgtctgttcccaggcttgcaaacccagtgccgtcgactgatacagacctttcagcaggatttgctgagctaaacaggtgtctgatgaaaagtgtgtaatcctcaaagattatcatcccctaaaagcagctggtgaccccaaactcacataatccagagagatggaagttgggagtgagtagcttgccaaagtttacactttggtgtttgaggaggttcatatggtttggtttggttccaggtagtggaagatggaggtgtgcaggggtgagggtgtctgcccctgtcgggggagatccctgtccctatccatgcccttgcctgagaacattattctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagccttaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttggccagcacctctggctcacagacaagttccagggaataatttcaccagcgattaattatactgcagctactgggatttgtcctccaaacatcactttgttttccatctgaaacagccaggtttctccagggagagctgaggttttctgattgaaagtatcccgagttaaggagaagtgttagagcaccatgggaatctattcaccaggggtgtactgtacttgtttcagatgcttcaggataatacaccagcttctaagataagtgctttttttttttttttttttttgagatggagtttcactcttgttgcccaggctggagtgcaatggcatgatctcggctcactgcaacctctgcctcccggattcaagtgattctcctgcctcagcctcccgagtagctgggattacaggcgcacgccaccatgcccggctagttttgtgtttttagtagagatggggtttctccatgttggtcaggctggtctcgaactcctgacctcaggtgatctgcccacctcagcctcccaaagtgctgggattacaggcatgagccaccgcgcccagccaagataagtgttttttatttccctgcatcttagatcaattatttggaatttttttggtaagttaagagctgtaacttaaaccaccacatctctatgatgtactcaataagtgaaatgttcttaccaaaaatttttcttccaatgggctatatcataattatgttgtgaagagcctagaaaaaaatagaggccgggcacagtggctcacgcctgtaatcccaacacttgagggactgaggtcaggagttcgagaccagcctgggcaaaatggtgaaaccctgtctctactaaaaatgcaaatcttagccaggcatggccactggcgcctgtaatcccagctactcaggaagctgaggaaggagaatcgcttgagcctgggaagcggaggttgcatcgagcccatatcgcaccattgcactccagcctaggcaacagagcaagtctctgtctcaaaaaaaaaaagtacaaagaaacaaaaggtggcaagaaattcgttttttaaaacatcgcatgttatgagggtcagagtagtgaagtgccaccagctgcagccttctgagaggaagtgctgctgctggttcaaatggaattctgtcctacatccaccaagcacgccagtggagtggacatgacacacacttttcttctaagctgtacagtttaacatattacaagtgagttcatttaactagtaaggaatcagaaatgtatctttgttcattttgatcgttttgatggattctgttttctcttacgtgagtagactttgtggacttccaaatggctcctggcataagtgccagttcctgctattagttccttgagggtctcatgagtcagagaggagagggaaaaacccactgcaagccatgcaggggtcccttcggatagtggccttgtgcagtctgcagtgtcggtgcacgtcatccctgcacacccgcctgctgtgctctggctggagcttgggtttgcagttgtcttctttacagcacccagggaagcatggcctcctggcaggtgttggccactccctgctttctcctggcctttgcaagcacagtgcaagggtgtttgctgaaaaagaccactgggctttcagtgtacccacacccatcagggctgatcaccctgctgccacctccccaggactcttccgtgactatcagtcatagcctgaagtctgtgtccaagggagtgtctcaggagacagccacttaacatggtaggagtagcaggtgctaaaaggtttatgcctaaatgctccccatggaccccaagttgcctgctggtttgagtggcctaacccatttaggctcaggccctgacagggtgtgtgtgcaccacttcggggtgtgaaagcatgaacagctgcggaaagcgtgggttttctgatgctggctgctgctgccttccggattagggactgtagcggggagacagaacaaaggaacacatgtgcttctgggtaagctggcccatcatagtgggggacataaggtatgggggggcacataccaccttggtatgaacactttggttgtacagaattctttcagcaaggctgagaggagtggggctttctgtccttgactgctggattcaaataagcaccagtagaggacctggggactttcacactcactgcaggggactttcaattgtgggatctcatggacaaaagggaatggttctatatccacggctctatggttctcacccccccaggagtacaaagctgggaccccccagcctcctgggtacgtttctcagcatgtgccaagcactttggaggcaggtgacggatgtgccaattatctgtattctgaggtgtgggctcccttcatactctggcaacacagagacgtagagagctcttcttcgtgttgacaggacacaatatgggctggcttcggcacagtggccatcactgtgttagcattcctgacacactgctattgaaagccccaatctgctgccaaattacatgtagacagtggtttcactgtaaaatgttgcggtgcttgtttgcattcagtcaaatactttgcacttaaacatgggttaaagagacaaataagtcaaaagaccttagcaaaacctgaagttaaatttacgcctattcttcataatggcattcagattaaagccatcaaaatgcaaaatgctgtgattatacccttcgagggttcaggctggattcttgttttgtatttctgcattactgtatttgcagtgattttgagatgcaggaaaatgcatcagaggcattgatttcttctttaacaaaaaataaccctaaaattgagaaaattcttgagaatgcagccattttggaaatgtagataaagaagaaaaatgctgaagatttgggtggtttatggagccgtatgattttgtcattgctgccacctactgtatgtggttgatgtttgtttaaacttaggaagttcatgaaggtgaggctgttgaaatagataattagagcaaggtagacatcattagcttatagcatttcttttctaccccataagtggctcttaattactgagacagccgccagctttcattcattaccttcaagtggatttaaagggctggtttctttttttttttttttttccatttttaaagttcctttgccaaggaaccttcacagtaatgctgtaaaatgcgttcaaaagcttaagatgctgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaacaagcaatatagactctgagtcaacagaggtccttctctttttattaagacccagctgtcaaagggtcattaggtccttcctgtggaaaacaacttgcccattaatgttgggggtggtccctcgacaggatttctgagtaagtgcctgacatttcgtttttgaaagaatctaaagctgtgggagacttagatgttgagacttagcaggagtaatgtcttcaaccatagcttttagtctttgttaaatatgtcacaatatgtgtttggaatgctgctgctagctgcgtgaattgacttagagtgccactgtcaaagattcaggagcgtaaacttcacggagatcaaatcactataactgggaagaggctacattcctaaagcgaatgcacttctctgttgtgatgtttttaccttgtcactactcatattatttctagtggctcctgttctaagctctgggaatgccacagtgaggaatgcccatttattttttctgccctaggctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcaggtgagtcctgggaccctgggcagctccgtggctcaggcatcccacaccagaaagggtccctggagataggtgcattcattccagttaaagactgaggttccctaacagtattatcaaaccttttctcctaaaaataacacatgaaatgacacttttttactggttggattccagtgttctgtaccctctcattgaggtgctttctgatttttcctaacgcagataacattagtgctagcatatgtccgtatgtgaagctgaagtgaaatttcagcttgtgattacatcttgttctgccttatcacattacagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggtaatgattgtctttatcatcctaagttgtgtaacttcaatcttgtagcattcttaagctaagaaagtcattaagatcgttgtcaaaagcttggttatgtagagatagcatgtgaaatgatatggcactaatttatcctaactgaggttgcatggtaagacatgataattttattgaattgagtatgaaaaatgaaacatttatcattgattacaaagcagcatttttcactactgagagcatgtaatcagatcaaattcggtgctgagctccaaggctgcagtgtcaattgattctttgtgtttatgaacttgcttaaagtgctccttgccagtgagcatgtaatgtagtgataaaggactcaaatcaattcgctgcatcattaatactgttaaatatcccatgaaacccaatcttctttgatttgttatcctaactgatgcaaaaggttcctgagatgatgcagctggaatgtgcttggctggctggctgtcctgatcagaaccgacttagagacactttgccattgatcctcagaggctctggctgtgtaactgccctctcactggccaccatttttaccctccccacttaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagtatttgtttcactctctgttctttagtcgtagtttatgtgtacccagtcccgctgatcatatatcataatcgtttatctcacagtcatgattatgtttacttttcaggtttgttagtgcggtgacaggaaaccagggacaggccagcctcctagtctagtagtcactgccacctgctggtctgcaggagtagagtaactgaggtttatgggaacaaaaaggggccccagaaagcacttaaaccaccctccaagacctagaggccaggagacttctctaaggtcatatgactcattagagatggaagcagaaccaaatgcgtgctcaagactctaagcctgggttgggcgcagtggctcacgcctgtaatcccagcactttgggaggccaaggtgggcagatcacctgaggtcaggagttcaagaccagcctggctaacgtggtgaaatcccgtctctgctaaaaatacaaaaaattagccagacacggtagtacgcgcctgtaatcccagctactcgggaggctgagacaggagaacccagggaggcagaggttgcagtaagccgagatcgcaccattgcactccagcctgggcaacaagagcgaaactctgtctcaaaacagaacaaaaagactccaagcccagtgctcttcatgctgtttctttctcttgttcttggcacagaattgttagaaagcattttaggcccttaattttgatggtgatattttgcatttgtggccaactgcgcattactgaatctcctcagatcttagtagcccagtgatgtctctagatagaccatatcatctccaatggtacagaaagtaaagaattgactttgtttttaggtaactgctcacccagatctgatatctttgtcttcagtatctatctgggacatagaggagagccaagactgatagagatatcacaatacaagctaaggctccgccccaaggccatctgatgtggcatctgttagggaacttgctgttctaactcccagctcagcgctcttctaggcctggcagtcttctggaagggtctccatggggaggtggtagaaaggagcatcccacaaagtagacttcaggcttaagaataatgtttccatttcttaggaggagtgtgtattcatgtgttgtatatataataaaagaaatttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggctcacgcctataatccccacactttgggaagctgaggcaggaggatcatttgagctcaggagttcaagaccagcctgggcaacaaagcaagactctgtctctataaaaaataaataagtatttttaaaataataataataataattgaatacagtttacctgaaggttagcttttaaccaagcatattgaacccttctttgcagtgtattttcaataatttggggggcaacaattacatcttagcagcaaatctacctgctattcctctatttgaattttgtgtcattaaaaacttttttgctgggcgaaaaacattttataattacaattatggacagtcatttgtgccaacctttagtgcaaacagaaaaaatatttttaggccaggtgcggtggctcacacctataatcccagcactctgggaggccaaggcgggtggaccacttgagctcaggggttcgagaccagcctaggcaacatggcaaagccctgtctctacaaaaaagaaaaataaaagaaaaaaatatttttatatcatacaaataagacatctggcatgtctttaacatttttagattccttctattaaaatattttgccaggttatcagttgctcacatctcagcagccaccaatacttgactttgttaacattttaaacagtaatcctttcttcaggtacctttcctttccttttcatagccctgaagtcctatggaatgagaaaaagtaggctggtcttgtatcatatttcccagtgctgtccacatagtgggtgctccttcaagagttctcaagtattaaatgggttaacccagtggctagttaattacagcaccatttataaagacattagagtctgtgatgaccttaaatgtctgtgatgtgaggaatattgaagccagcaagtaccattggaaaaatatatgctagaaaagcaaagcttagtttttaaaatctccagtcaagctgctaggatgttccctctcagagcatctgcttgagtaaacaactgttttatttggaaaacacttgcctgtgtagttggagcccgagagggatgttagacatcaaatggaaggttaagtacaaaggcattacagaagtcaccacgtgtaagattctcagacacgcgttcagtacatgtctactgcatatcgactcaaccatttaatttctcatgagctcttatgtgttatgtttggaattaatttcagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaagtaagtagaggaatgataaaaaccttacccttgagaatgtctgtatctgactgggtgccaaagagcaggcctctggcgtgatgcccagaggcacctgcgaagtggtgctgatgcacctggagcaagtgcccatctgccctttcccatccttacaagcttctctcccttcttcctggaattggattttatgttaaacaacttctaaggccagaacattcctctaggtgggttcatcttacttaccagaaattggcttatccccaaaaactttgaagtctgttgacaagaaacacattacatttctttgattctaatatgtacttttttttttcacatttagttatttctgaaatcaaggtatatattattatcagtgtgagcattgaatggaatcgtttcttttttcctggaaaacaaatattagtaaatcaatagtacattttataatcagtagtgtcgtagtatatactactataaagattcatctaaactaagctgggcatgatggcttacacctgtaatcccagcactttgggaggctgaggcaggtggatcacttgagcccaggagtttgagaccaacctaggcaacatggcaaagcccctactctaaaaaaaatacaaaaattaatcagatgtagtggtgtgcacctgtagtctcagcacttttggagactgaggcagctggatcacttgagcccaggagtttgagaccagcctgagcgacatggcaaaaccccatctctacaaaagatacaaaaattagtcagcagtggtggtgtgtgcctatagtcccagctacttgggaggctgaggtgggaggatcacctgagctcagggtgagccatgatcgtgccactgcactccagcctgggtgacagaatgagaccctttctcaaaaaaaaaaaaaaaaaaaggaaccatctaaacttacccacacatcaatattagctttgataatattgcataacataaaaatcagtaaactgactttccttttaagttgacagggacacctctaccccatcctctaaaaaatacactgaacaccagtgaatcgtctttaaaagcacccatccttgcctgtcaggttgagaacgtgtgctcccagctgaatcatgagggtttatggtatactctctctattccctggccaagatgactctattcagaacttactttaatctggggaacaggccatctcatttccctgggaaccacaggatcactctagcttttgaaaagccacagttttaagaacatatgcaagcatcttcttgattttcttagttcacagaaatgctattcctgcatacagtattttgctgaaggaatgacttcttaccctgggtatagagaaaccaagccttattctttgggttttttttttttaaacaaataacaaactgcagtgagcgatcattttgtgtgtgaaaatgaggtttatttccccttcttggctgtcttctcatattatgcctgattcctttcaggatgtccttctttcttaaaaataattgtcagaaagctcatcttctgattttgggaggtgttccaacaaaagccggtaggtccagtagcacgtagaataagaatgcagaatccagccaggcatggtggctcatgcctgtaatcccagcactttgggcggccgaggtaggcagatcacctgaggtcaggagttcaagaccagcctgaccaacatggtgaaaccccatctctaccaaaagtacaaaaaaattagctgggtgtggtgatgcatgcctgtaagtcccagctacttgggaggctgaggcaggagaatcgcttgaacctgggagacagaggttgcagtgagccgagatcatgccactgcactccagcctgggcaacagagcaagactccgtctcaaaaataaaaagaatgtggaatccgggggcactggcatggctattacctgccattgtgaatagaaatgtcctgagatgactcttaactcgggcatggtactcggcacttctcaaggaaacattctacatcacatatgtgttcttttcagctggtcggtttgaatgtaatacttgcaggtaagtttatctgtaatccttttattacctaaatcagccagtgcttactctgctgtccaccagttggactagaactcactctattctggcagaagggatatctgttttatgatgattgtgagatcttatttttattctccaaaatagagtttctaataagactattgttctatataaagcttttcctttaaattgaccactgattctagaagattggtgtaatctaaagatcttaagaatacttgggtgcttcatgcatatatttattaatatatatttattaatatgtatatagctattcatctgcttgtataaatatgtacatatttacatttatattaacatgtgcatataggttcagtaaaaagctcacctgaactgaaatgaacttcacaattatggtttgtttctaagtgtctttaatatgcaaaccttacatcagcaacatattgatccagaattcagtgtggacagaattagtgttaaaaagaatacctgtattttaaatgttcaggaatttgctagtaattacattgtagtttgtatcatgcaaaaatgatgatcctaaaaatgatgattacaaatgcatttgttttgggtatttagttatttactgatttgtttcagaggtacacagcttatttttatgccagagagaacattcaaatcaaagtaaataaatcatgtcttccaagatcatttacatcctataaatgtccacaaacagaggtttactttctctaggtagatatgagagttaaggcttctagtcatttttccaggacagtaatgatttgtatataagctagcattaattcctttcccctatatttcctaatttgtaaatgttcaaattgatttttttttttacactgtggaactctgggcttttgcatcagagaatgtcttgttcattaaattcaaataagcacattagcattgcctatatccatgtgttcccaatatgttactctcccaggcctaggttatttacttggtttataacacaatattattacacattagccttgattatgtctttaccatcaacttttaacatgccaaattgaaagcagtgtttgctaattaatttagaggaatgaattcaagttgcccatggttatgctttctaagactgttttttttccttcccgtttttgtctcttcactaagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 281 - DNA, 206210 bp, Homo sapiens; identical to SEQ ID NO: 280
  source 1..206210: mol_type = genomic DNA

SEQ ID NO: 282 - DNA, 206210 bp, Homo sapiens; identical to SEQ ID NO: 280
  source 1..206210: mol_type = genomic DNA

SEQ ID NO: 283 - DNA, 55247 bp, Homo sapiens
  source 1..55247: mol_type = genomic DNA
acagtgttcgcggctgcaccgctcggaggctgggtgacccgcgtagaagtgaagtacttttttatttgcagacctgggccgatgccgctttaaaaaacgcgaggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccggtgagtcccagccccgagttggctctggcgcccgggtacccgccagtgccggctgccgatgaccgattcacgctcccggtactggggccccctctgcccagccacccctacccagagcacccgggctgcgcggccccgccgagggtgcgggctttgttcgcattgtctgcgcgcacctgagcgcggccttcctggcacggcggcgtcgggggaagagcgcacctggcgcgcgcctccctcgtggccactcgcggtccgtcccgggcgagctggcggggttttgggaggggtgcggtcagcaggtaagtgggtaggggctccgggtacaggggtggaggagggcatgtattaaacccaagctgccctcctggcacagtagcggggcccccttccctggcggccgcggaaagggactcgccctttgaataaaggctttggtgacatgctcgcttccaccccacaccccactacaggacatacacaggtgttaaggggacttggggcagttttcccaggcagaacgagtgcccccagcgaagtgtctgcaagcagaacctgagaggggccggctgccccgagagtcctcgcgcttgggcagtgggaagtccaggggtttgtcgttctggtgacttcccccacctggctcagccctgcttcctgcatgtctccttcccttccaataaggctaacaaaactttccctagctaagccgacctttccctcccgccttgggcccttggccacctgctgggacggtgaatgggagagtctcagaattgaaccttgaaaacttgctgggggcaccagacagaagagaagggaggagggcaccttgctgcttgtgattgtggaatcaagggctccagctgaagctgaaaggggacttagcaatggggacctcatgccatgtgtttgatgtcttggagattggaataattagaacgtgtacatttttcaaattacaagctgctttaagtaaaaccccagaacctctaagtgttttataaattcagtcccaaaaattcaaggtctcttttgctgttaaggtgacactatattaagaaatgtcgatttattgaagagtcagagaagtgaagaggtcagaaaggtaccactagagttggcaaaagccacaggcatgaatttgtaaatgctgctggctttcagcaggctgaagccatcctctcttgtgactgatgggggttcagagctcctcaggccttactcttcttttgtaaaatccagcccagagccatctcctagtagtgtaagaatttctcagactaggtccccaggcaaatcccaggttggagaagaggattgctttcctcatcatctctggctgaaaaccatcagtgtattttcattaaatctggtttttggtctaccgtacagagattacagccagtatttcccctctcttcaataggcacaagcccctgggatatccgaatcatagtcagaagcccatgtttttacagatgaggaaactgagacccagttttagagtgttaggttcaaagcaaaattgagcagaaggtacaggtttcccatatacctcctgtccccgcctatgcacagactcccccattgtcagcatcccccactgcagtggtacatttgttccaactgatgaaccgacactggcacatcattatgacccaaagttcacagtttgccctggggtttgctcctgttgtacattctatggctttggacaaatgtaaaatgacataaatctgccattatagtatcaaacagcatagtttcactaccgtaaaaatcttctgtgcatcccaccctccctacaacacatggtaatcactgatctttctactgtctcaatagttttaccttttccagaatgtcttatgattggaatcatgtagtacgtagctttctcagattggtgtctttcgctcggtaatatacactgacatttcccctcctggctttttaatgagcatcataaaaacagaatagttatttggcagtgacggcatcataagcttgtggtgaaaatgccttttttgttaataactcccctgatgtgtgtgcatcttacaaagcattgtcctcacatcctcagtacctggaagggtaccgggcacagggcagatgcttaataatttttactgggtaaatgaaatttcatgtaattatagcaatgagagggtcagcaacactacgaggttgttttagaacagtggtcctcaaacttttgcagtgcatatatcagtaaatgaaaacctagtttaattgggaggcctgcaatagaattgctcatttttaattttatccaataaggctattttaaaacaaatcccacccccctccctatcatcaaggaggctattggaagtctgttggtgattgtgtgtgtgcattccctgcaaaatgtttctgtataaccccaaggcagcacagtgggacagctgaatgtatttgaagtcccttcctttgtgtgacctttcgtcttctaaacagctctggactgcttaattttcctcttccacctaccacattagctgctgactttccttgaatgtgattactaccctcggtcctccccttccttttcctgatcatgagtctcttctcttgaactagatttccctggtctcaaattaggaaactttgcccttgccccgggagcctttgcatcgtggtttcatggggtcctggcgacaacctttccagggaaataggatggatggtgttacctccgttttagagagaaggaaattgagagactgaagtggaggaatttacccaggaggctcatgctcaggtatcctgccatcagatggttgctctttccagagcatctgtgtaccgcatgcctcatagtaccaggtgcatctgcatgccgatgcctctgtgtaccacgtgcctctgtgtaccagtgcctctgcataccgcagtgcccctgtgtaccagtaaatctgtgtatcagtgcctctgcataccagtgcatctgtgtactgtgtgcctctgcgtactggtgcctctgtgtaccgcatgtctctgtgtaccacgtgcctctgtgtaccagtgcatctgtgtaccgcgtacttctggtcatagctgagaagtcctgggctggactctaagctgggtttttctcgctctgtggccttgggtctcgtcttctccaagatcatttcttcatctataaagatgtaaatgataatatctaccctacagattatgggtgttgttaaatgaaatgaatatattaaatgtaatgataaacttttaacatcattcatttagaaaacattttactatttagcagagacttttctaccctgtctcactggatctttacaacactgggggagtttatgaaacagattctccccatttggcagatgaggaactaaggcaggggaggttgttgcttgcagtcacccagctgctaggagcagagctaggttggaatcctgtctctggactttgggtcctgtgtgtgttctcccacacctcagggctaatcccagtgtcccatacagtgaaatcgggttgtgtacaatttaaagcattttcagatatcatccatcaaaacaaacatgaactctcttctggctaaaaatgtgtctgcagatgcagaaagtatgggagggcttgtgatctatgcccatcttcccagcttttctccctaaccctccagggagttcacaaatggcatgttgcttatttcttggtgcggacttttggttgttaggccactgggttctgaaaatttactaattattttagggggagcgtgactttccccaggcagctttttaaatgctctctctgccatatcaaactagaaatgtgtcatctacctccgttgacactctgagcctgagccaaatattttaccaaaggttacaaggaagatgattgttccagcaaggacttccccaccggatatttttacctctgattttagtcttcccattcaggtgtgtactgttctggtaaagggctcagatttccatcctgctgatttggaggaggctgccaacggctaatctatttggggttggaattgcattttgtaaggaggtagaaatggtttcctctttttccctacactcatttcatttccgatggtagagaaggcagacattatcctgcaaaactgccttcagcgatccccaatccggctcttctttttttaaaaagtagctttgttttggcttttatttcttcctgtgtcacggaaaatgtaattcctgggtagtgcacagtggaaatttttgtggcatcctgcagcagacttcacatgcctgctgtcccaagtgcagctggtgctgcgtgggaaccaggatccgaaggccacactctgttgaggagatcaggggcgtggagagcatctacatccatggatgagaactccagaagccaggaataacaagtgggattagcatgagtaatggaacagaagggaacaaggtgatgagcgaggtgtaacggaaaaggcttggtgaggcatacctgagaatgggtggtctgttccagcccctggcttgcagatcactcccaactactttgtaggaagccagagggccctggtaaatctcatcttgtgccggatggagtgtgagagctgctggcaggtattagctgggggagaaattgccaacgtgcaggattcagggtggcagattttttaaattatgcttctgtgcttctgaactgcctctagttcatagcctgttttctggagcctggacttctgccagagtgtcacctcttaccggcagccccaacacctctcccttgttgaacatcctgtggcagcttcccccagaaccgggaaggtgacgctaggaggccagaatggaatctgatccactgattagctgtgtaagctggggcagaacacttcacttctccatgtctcagcttcctcacctgtgaaatgggaatagtacaccctccctggctggctgcgaggattaggagagaagacatgaagggcggagcctgtgtgtcttgtggcaggcacataagaaatgctcattacatggtagtagctgttgatttttattgtggaattcaccctttaaaaaaaaagctttccaggtgtagggctgtattttggaggtcaaattagtattgtaggaaaattttgatatgagaggggaatgagctgcctattcgagatgactggatgggaatagagtgcaaacaatacttcaacatcatcgcaatagcgttcatttcattaatcttggtataaaaaagaatgcagtgaacacagtgagtgcaatgatgccctgaaagggtccctctagccctcccacaggaggtattctggtgctttgtttatctagcaagcaaggacctcccctactatacatcaggcacatgcaggtctctggagctccagcagagactagatagtctgtagtctcaggcatttgccgcctggcagtcaagacaaacgtatcactgggcagtttcagcgtgggctgtgtgacagtagggattgtattgagggggacaggggagggaggtgctgcagaagttgcagagccaacaccgtctgattgatccaaacagctaggagaaggcatttgacatcctgtgtgcatttgcagattgccaacatacattctattttaatgagcagaaacttgggcgcctctggaaaaacatgcagctgggcaagcagaggcacatagtggatcgagatcaagctgcttaagttggtctcatagcacggagggaaggggactgtgtttactgggtgccttcctatgtggcaggaaccttctgtacttccttccactttatcctcacagcagcctggggaggtggctgccagaatccttgttttataaataattaacaggcctgagcctcagtctcctgccagtgcccagggtcagaagctgtaactccgtaaaatcgtcctgaacctaaggaatagagacagcattgagaagctcttcaccgcatcctcaatgcctcgccattgcctgactcacaggcggcaggtgggggcttgttctgcctctgtggtgtggagtaagagggaaaaaaaaaatgtccttaggggaaaatgagtctttcttgctggcatgcacagggctggaagctagcaggaagtatgtgctgcaggccagtatccttctcaccacctttctccctttgatcgtgtctgtagagctcctgacatactggctcttgccatgttaggtgtctgattttcacttagatcaggagaagacttgagcctcttagtcatttgaagcaggaagaccctgcacgaagactctcagctggcagggacatttgttttataatagtttgttttaggactgctttgaaatccaaggagctctatagacagttccaagtggtgcatattttagaattaggtagaatctggtggcatcatggaaataaccacacagtctgagaatattgggtggtcagtacatgctccatcctccaggaggaccactctctgtggcaccctggactacctgcccccgccccccgcccaagatgattggaggtcagatgcatggtgagaaggtagatctctggagccttggtgttctttgctatgaatttttagttgggaagcctccttttgaggcaaacgtacaccaagagacctacaaaagaatatcacgggttgggctgggcatggtggctcacgcctgtaatcccagcacttcgggaggccgaggcggtcgtatcacctgaggtcaggagttcaagaccagcctgatcaacatggtgaaaccccgtctctactaaaaatacaaaaattagctgggcgtggtggcgcatgcctgtaatcccagctactcagaaggctgagacaggagaatcgcttgaacccgggaggcagaggtagcagtgagccaagaccatgccattgcattccagcctgggcaacaagagtgaaagaaactccatctcaaaaaaaaaaaaaaaaaaaacgagtatcatgggttgaattcacattccctgactgtaacagagggacccaggacctcattttaagactgttgaagcataatcccagccagaggccaatgctcagagaagtacttgaacacccctggatcacagcaaattcatcaaaaccattaaattcccaaaacaaagaatcaactagcaaacagtcttaggaatcgtgcagggggagaaatccttgaaccagggctgctgtataacctttcaggaacatgctactaaaatttattttaccattgactgctgccctcaatctagagcgctacaagaaatatttgttttactgagcacctggcaatgcctgaacctccctattcagaaagctccacatcaataaacatgacactctgaagtgaaagtagccacaagaattgtgctacttatactggttcgtaatctggaggcaaggttccgctgcagctgccccctcagcctgggccaggcatggtttcttcccaggagacaaatccagagtgtggctgtggggaaagtgaccactttgccctgactcgatcggttaaggagctgtgcaataaccttcccagtacctgagtgagtgtgtcacttattgggttggccaagcctagtaaagctgttggaatgaggatgtgattctttttaagtgtgaaaaaaaaaaaaaagatttctgtacagatttgtatttgttctctggtggcattcccttagaaatgctctgtgtctgtccagcaccccggtaggcctggttgggtttctagtcatctttaaccacttatctcccatatgagagtgtataaaataggaacacatgctctacctccatttagggacttgcaacctctgcatcccaggttcaagtgattctcctgcctcagcctcctgagtagctggaattataggtgcccaccaccatgtctggctaattttttgtattttcagtagagacactgtttcaccgtgttggccaggctggtcgtgaactcctgaactcaggtgatccacctgcctcggcctcccaaagtgctgggattacagacaagagccaccgcgaagggcttattttttaaaaaacactggagtcatggcatgtgtgtaaactttaaatatgcaaataactatgtcaaaaaaaaaaacaaaacggagctggatgtatcttgaggtccaaacatcataggtccatgatggaggcaggagtccaatgggacttttaaaaccataaaacagcttagccacatcagggcccttctcttcactttgtaagggaggaaccacagcctctcccaaggtcacagggcaccaggatgaggatgagggcccctgggttcatgtaggctctctgccaccatggggcaggtgtggctcctgcatgggtggtgaagtttttttttaaaaaaacttctcaaaaaataatttttctcagccaagtgtggtggcatgtacctgtagtcccagctactcgggaggctgaggcacaaaaatcacttgaaccccgggaggcggaggttgcagtgagccaagatcgtgccactgcattccagcctgggctacagaataagactccatctcaaaaaaaaaaaaaaaagtcctcttccttcagccggattacgatttataaataatttagatgattagtggataatttagatagtgcaggctttcttcagatgttgtcttcttagctaggggaaggtttgttaaccacattagaaggtttcagaagatgaggacattgaaaatcagatcttcagcctgttgaattctaactcctcatgaagaaatggagaccctgagaaagaagtgactttgcccagggtcacgtggctagtcagggcccaggcagagccaacacccgggcctcttaactctggggagagcaggagagcacaccttcccagggcccgtggagggctggggtgcatttgggggtggatgagagaggtatcctggggaagatgttagcttggtgtctaaaaccaaagtaattggagtaaagtcttccatgacttgggaattggggacttttctagttattgtggtgagggcctccagggtcatatctgtgacctggaaaaggctgagttggcatcttgtttggcggtgtgacttggggcgttcacagaactaattgctgatactttctttcttttcctgtgtccctgtagttatatcaacatgccccctttcctgttgctggaagccgtctgtgttttcctgttttccagaggtaagatgtgtttattggtggtggggaagtactggcgtgttgagtaggggggttgcttgcttcaaatcctgttgattttcaattctaaaggtctcttgaatccacctgcatctcccctccatggccacctccctagtccaagccatgtcatcttgtgcttggaccactgcagtagcctcctgcctggcctccctgggtcccccggtcctcctccaacccattctccatgcagtggctatttctttttttatttttaagttccagggtacatgtgcacgatgtgcaggttcgttacataggtaaatgtgtgccatggtgtgtgccatgatggtttgctgcacctatcaacccatcacttaggtattgagcccagcaggcattagctatttatcctgatgctctccctccccaccccaccactcgacaggccccagtgtgtgttgtttccatccccatgtccatatgttctcattgttcagctcccacttattttatttatttatttatttgagatggaatctctctctgtcacccagactggagtgcaatggcgcaatctctgctcactgtaacttccacctcccggttcaagtgattctccagcctcagcctcttgagtagctgagatgagaggcacgcaccaccacacccggctaatttttgtatttttagtagagaaggggtttcaccatattggtcaggctggtcttgaactcctgacctcaggtgatctgaccgtcttggcctcccaaagtgctaggattacaggcatgagccactgcgcctggccctcagctcccacttgtaagtgagaatatgcggtgtttggttttctgttccggcattagtttgctgaggagaatggcttctagctccacccatgtccctgcaaaggacgtgatcttgttcctttttatggctgcatggtattccatggtgtatatgtaccacatgttctctatccagtctatcattgatcagcatttgggttgactccatgtctttacagcggccatttcaaaatgcaaattggatcatgtctggacccctcttcacccccagctaaaacttttcagtgactttctgtggctcttaagaggcttttctcatcttaccccgtggccatcctgagtcccctctacgccctctgcaccacagcccactctccttccagtcctgccctgcatccttgctccccgccaccaaaaacattctgaattatgttgcccctgtgcttggatcaccccctcatcccaacactgccaccctggcaaactcctccccatccttaggccccagcacaattcccctgggacctccagatcaagtcacatccccctcttcaaaccccttgtagaccttgctctgtagcacttaacacagatatgagttttgtgtgcattttaaaaaatgacatcttttccataagatgtaaggtcctcaaggaaagagactgtacattctttaacattctttattcaccactatattatttcagggcgggcatggctcacggtttatgcttcagaaatagattaatgaataaataatggagcaaatccactttctttttacttcccactttttccctttcaagttctagtctctttgaaatatgagaaggtaggaaggaattgatgtgtctgcagattgttgtcttacaagtaagaacaggtggactgggcggccaagctgtcacagcctcgtgaggctcggggtccccttctgtaaagccaaggggttgcacagtggcctctgggattatttcttgcagttcctccctggtctgtgtttccatgagtaggtatttgttctctgctgaattggctactgttaatacctgcctgtttcctggaacctagcgaggatcagaaatgctggtggaagttgagggctggtggctccagcctggctgcccagcccaactgtttccctctgtctctgagccaggtggggtggatggaaagtataacacagcagcttcatggccaaggggttggggagtggtgagatgtgtttggggccagggcctgaaagaagtctctggagtcctgggcacagtccaggttctgttccagcttgtcatggacctttgccttctgtggccctgtccagcctccagattgcaatcacatgcacttgttctgatcatccttgggttatacagatgaggcaggggaggcccagagaggccctgtgacatgcccaaggtcacacagctatgtagcagacatgggactaacacccagttctccctactcctgggctggctgtaccgctcagcttctctggaaagataagaatgtacaaaagttctctctaagacttggctgtcacatctgtaaagtgaaagaatttgactagattagtgattctcaactctgcctgcgcaatagcgtcacccatcctgcagactgaagttccggagcccaggcagctggtctttagagggggctgccgacttggttggaaaaagcaacagcaatcacacatgaagcagctgcctgttcagggggagcctctgcagtcctgaagacatttcacagggagcattggggatgtcacccaggctcaaggtgggctcatctgaagcctggcacctgccatgacagctgagcacagggcacagaggcacagttagttagctgagtgacatctttagtgagtggtctgtgctcacagagctcccttgccttctcatcctggggagatggctggcctgccttcagctggagagtttgctggtaagatattttaaaagaaactgtatttttctgttctttttggggtctttaggattcctcggctactgggccctttgtcaggagaataattcatggactcagctcaggaaaccttagtgcctatgtgtttacgcagagggctgggcgaggctctgtggaggactgggtggaaatgcttctgtcctcagggagcttccaggcaggaaggtgaggggctcgtgggaacagaaccgcattatggggtgggccgcagtgggcccaggagttggcatggtcgtgatctctgaatgcagtgagcagaaaacctgtaatttttttttttttttttttttgagattcagtctccctctcgcccaggctggagtgcagtggtgcactcttggctcactgcaacctccgcctcccgggttcaagtgattcaactgcctcagcctcgaaagtagcctcgaaacacacccagctaatttttgtgtttttagtagagatggggtttcaccctgttggccaggctgttcttgaacccctgacctcaggtgatccaccgcctcagtctcccaaagtgctgggattacaggcgtgagccaccccgctggcctgtttttctttttaatgctgcccctgcctctgtcccaataaatgccattttttaaatgcaagtagatttttctttaattttgtctactgtctttctttctagtctaagtcttgtttctgtctctggtggcaaaacagcagcggcagactgtgccagacctaatgagagagatttgtctggcagcttttggctgtggagctgactgctggcacattgacttagaatctccatgagtagagattgaggggaggagggagtattaggtgagcaggagctgtctgctcaaagatatggtatggggagagactagtttagtttgcatgggggactagtgaacgggaaggagccgggaaagacagagctggaaccagccgaggcagtgctgagttagtaggttgaccaataacgtgggtcattggtgtcactcccccagactgaaaccctcttttggcgtctctcttgtcatcactttcctggcagttgcaaaccttgagaccaggtgccctgtactgtgtgattcctcctggcctccctgctgaatctccttcacctctctccacagcagcccccatgctcatctgccattcaggttcaaacagttctcctgcctcagcctcccaagtagctggaactataggcgcccgccagcacacccggctaatttttgtatttttagtagagatggggtttcaccatgttggccaggctggtcttgaactcctgacctcaggtgatcggcccacctcggtctcccaaagtgctgggattacaggcatgagccactgcacccggcctgcttgtgttccttcatctgccccacttccgtgacctggccgctcctgggctctgcccctctagctttgtttcctctgtgctgtcactgcacattgacatttacaaagcatctgagtgtacctctcttctgctgctagacacctaccaggtgcagttgcagagaggatgttggcttttccaaatgtcccttctggggatcccttattgtcttccatcatggttggttcactgttcagcaatcctgtggcctcctcagtgtcttatccccaccctccaatttcatttcccctcccctctctcctctcccctctcccccctccccgtcccccctccccgtctctccctcccccgtccccgtctcccccctcctctcccccactcccccctcctctccccactccccccagttattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgaggtaattggggggtttctttatgttatccgtctggtaatttttgagatgcaagaatcatcactcccccacattctaggtttctctgatgttacctgtttagtcaagtcacttaatgtggagattgagcctcctcccctctcagcattttaatggctgcttctggtgttttctctcctagtgcccccatctctccctctccaggaagtccatgtaagcaaagaaaccatcgggaagatttcagctgccagcaaaagtaagcccaggttcttcttaaccctccagatgcccactcagacctctgtgtgatggactggatgagaaccatgttcttccagagagtttctgcccctttcccatcttcctttcatgctctggccagagtcattttccccaaacagggacctgaccaaatcacttggtttaaaaacaaacaaaagtgggtgcctgtaattccagctactcgggaggctgaggcaggagaattgcttgaacccaggaggtggaggttgcagtgagctgagattgcgccattgcactccagcctgggcaacaagaggtacactccatctcaaaaacaagcaaaacagctcagtaaacctttttttgttttgttttaaagacagggtcttgctcctgtcgcccaggctggagtgcgatggcataatctcagttcactgcagcctcaacctcctgggctcaagcaatcctcctgcctcagcctcccaaatagctgggaccataggcatgcatcaccacgcctagctagtttttgtgtttttagtagagatggggtttcgccatgttacccaggctgatctcgaactcctgaactcaagcaatccgcccgcgttggtctcccaaagtgctgagattccaggtgtgagccaccatgcccagcctcagtaaatctttattattgaattacttggcctgtgcctcaaggttttctgttacctgctcaccaggtaacggggtggctacttgccatgtccatctcccaccatattccttcctcttccaccctcatcagtatccctccacattgctgctgttactgctactgaactcttgggtaacatggcctcacatatcagggtgcctgtgtccacactagactgtggtcccccgaggcctgggaccaagccttttcagtgctgctcactagcccagtagaccccctcatagaacgtaattgatattgttgaactaggttcttccattattgtaatacaaaggctttcacgtaagggcacatttgtgagcagcacacctgtggtgcgtgtgcttcctgcttcagaggagggctgcttctgcagttctcccctttcatgctaagagggacagcagcctggcccaccacaaggctgtttgtgccttcactctgcttcagaagtgagaccgacttgctcctggttgtcatctgtctgtcccgctctccctagtgatgtggtgctcggctgcagtggacatcatgtttctgttagatgggtctaacagcgtcgggaaagggagctttgaaaggtccaagcactttgccatcacagtctgtgacggtctggacatcagccccgagagggtgagtgcaagtcttgtgggtgtttgtgttagggcgtcttctgtgataagggacagaaacccggtctcaagcagaggaggcatctactcgcttgtggagctgggaagaccaaggggctgaatcctggttcctggcatggtgggatccaagggctgagttgaggctataaggcatctttttctttttttttttttcccttctctcaattttgttttcttttggttgacttccttctcaggcaggttttcctgacacagccaagttgtcctgcattgttcctcaagctagtgaccctattagaaattaaggggacttctttctctagatctggccaaagtcccaggagggttctgattgggcaggcctaggtcacatgataatccactgaccaatcacagtagtcagagggaagagagtttctggccggacctcagttaagagctctgccatgtttttggggtagggagtagatttgactttcctctggaaagagaggttgggttgtgtttgcagaacaatgggaaagggaaagcatgctaagcagactaaagctgttactacctcagtggactgaatagcacagctcctaccctctcttgcacttgagaggaactattcctgcttgagtgaatccagccagtatcttcatttcttgttcttcaaatagtaggtcttaaatatagcagagtgtggtagctgtggctcttatttctaaaaggggcatttttttttttaacaatccaatagaaaaatgggcaaggaacacagatagttcccagaaaatgaaacacgcaaggccttcaggcatatgaaaagaagcccaacctcactcactcagagtcagcaaaccctatgcctaatatacagtttttcacttactgggttagcaaaaaaaatcctaaatttggtgacatgcttcattggcaaatcttgaaaaaaactggtgttgtcatacactgctggtggagtgtgaaatggtgcagcctctaggggagaatccaatagtattcatcccagttacaaaggcttggaccctttaacccagcaattctacatcaaggaatttattctacagtacacatgcccatgcaaaatcgtacccatacagagttattcattgcagcattatgtgtataaactgtaaaatatttcaggcaatccagatgtacgctgagggaggacagataaatcccttatgatgcattcgtatattgaaacgctaggcagctccagaaagtgagtgaggaagctctctgatatggaaaaacaccagaacaagtgaagtgtcaaagtaaggtgcaaatggtgtgtataatatgttactttctatgtaaaagataaagggggatgaatgaaaatctgtctttgttttcttgtatcggtatacagttttcttatatctgtatacactctggatggatttgtaagaggctgaggacagtggttttcattaagggggaggttgggaagtgagttgacagggcacaaggccagaggcagactcatcaatacagacttaaatattttctggattttgaatcacgtgaacctactcaaaagtcaacttaaaaattaagagaggctgtgcgcggtgggtcacgcctgtaatcccagtacttagggaggccaaggcgggtggatcacgaggtcaggagattgagaccgtcctggctaacatgatgaaaccttgtctctactaaaaatacaaaaaattagccgggcatggtggcacgtgcctgtagtcccagctactcggaaggctgaggcaggaaaatcgcttgaacccaggaggcagaggttgcagtgagctgagatggtgccactgcactccagcctgggcgacagagtgaaacaccgtctcaaaaaaaaaaaaaaaaaaaaaaattaagagatgatgtagcctggaaaagctgtcattacttggatgagagactggttgcatacaggttgaggaaggaagtggttttccaagataacattcctagattaatcctagttaaaacctctaggatttagaaacatacatggcttttaatgagggccagattttctgcagaatggtgtgtcatttggggagctggagcacacttcctggaccttagaccaccttgcacctgaggacaccatagcaggcatcatttaatctaggcacaagcagcccagaagatttctaaccatgatgttaacccagcatagaccctaaaagggccaggcaagaagcgccagttccccaccatcctctgcacaggaccctgcttttaaaagggttccttatcaggtgtcattagttactcatggaggaataacataaagagaagaagcatgaagattaaacactgttgaccttggcattgatgtagtgtgtcctgaaatgagtagcctggagaccctggggttggctagttgggaatgaagggtcctatggattattaatgcatgtttcacagatgagggaacaggctcagagaggctaagtgactgccgagggtcacacagcaacctcaggagagagttaagtgtggaagaactggggcttttgactcagcccaggacttgctccattaggccatttgtcttgaccctcagaattcacaccctgctatcacacagcaaatggccagcagtgtggcagtgtatgtgcgtgtgaggagggagtggtgtaagaaaaccgtgacaagaaatttcctggctgatgctattgggagcagatcccagagttcagggaatttaacctgagcattgctggaccacatctagaaagtgtcattgagttctaggggctgacttcttggttagacttgggccaaacagtcagtgcccatgagaaggagccaggacagccagaggcctggaaacctctatgaatgagggaacacgattatcattttcatgtgaaagagagcagacaatggctctgttttttaagggtagaatctgggtgttcagggagttagatttgggcttaacctgaggaaagctttcttgcagcaagacttgggaagcagaggaattgtttacttgggtaagtgaattagtgtcttgacctccaaggtcaggtggaccccttggcatgctgcagaagggtttgcatgagggcaatttaagatggtttattctgacttgtggcttcaggctttatgtttttgctgctgcatttttttgtattctctttttgttgtctccatgtacaaggcatttcattcgtgccatgttttactttttttaactttagttttcaagaagaaatgtcaagtagctgtaaattaagacttttatggatgctctgttgttaaggtggatttaaggtgtttgaagtcttcctcttaacacttaaaagctgagaggttcacttcctggctctaatgtagtgactggggcagagtgattatggctggtaagatagctgggcgggcctgtttctgagcgtacagtaaactgaagataaaaggcaactattttgttcccaaaccaccaattaaacaaaatgctttaactactgacttaagctgcttccttcttgttttgaagttctgtttcttcctgtttaactcaagtaaatacacccagctgttggtctcaggggaggttattttttcaactaagtaattcattcacatgggttcaataaaaagatgtacagtgaaaagtctccctttcacccacacattttccatttgccctgtccctcaacttgtgttcttgagtcccttccggaatcactttgtgcaaatacaggcaatatgaataaatattcttctttctctcttattacacaaagcgtagcctaccgtacacattattctctcatgcctttttcctcctcacattttcatggaaatctttgcgtatctgtatacaggtataatttttttacaggtcattaaaatgtttcatcataaggatttctccaggtctaattaacccctattgatggatatttgctgttacaaataaactgtgatctcgtaaataacatcatttcacacatacgagtaggatacatttccagtagccctatgcatttgtttaaattttattatttttaattttcaataaatattaaaaaattgccttccatggatgttgtaccaatttacatttctacaagcaatgtttgagaatgcttgtttcaccccgaaaacattgtatatgtttttttgctaaatggatggggaaaaatgctatttcattatggtgaggccaggtgtctttccatcaaagagttacttgtatttcctgttctgtgatctctgttcaaatcctttgcccattttctgttggattgttggtcttttatatgttgattcccagacacctttttatatattgaggaggctaaccctttaacatgaattgcacataatttttccattttgtctttatttttttatgccattaaggtatgtttcgtcccacagaagttgttttttttttttcatgtggtcacatttatcaatctttcctttatggcttctggattctaagtaatagaaagtaaggtctttttacacgttgaaattttagaaattctcctgagtttttctagaactttcatatttagatttttcacactaaaatcttgaattcatttgcagtttatcctttatttttggtagattgctctccagttgtcccaatatcattgactgactagatcatcttttctccctggtttgagatgcccctttttaatcacacactaaattcaaggaaaacccaggaagcgctccttcccagaagcttcttcctgagatcacctactggtccgtcttcctgtgtccgtctccccaatgtgtccactgaagactgagatttctttctgcttaaggtgcccaacagctcctccccagagcatcctgcctgcaaaaaggaaccccacccagctgatccggagcagatgcagcccgcctggtgtggcagggcgtttccatcatctcccacgtcccacgcctgtcgagggaacggcagcgagggaattcaagtggggagcagagggcagcatcattgcttaaatatgactcacttggcccatttgcactcttggccagaactagggttagttttgagaatagttacagagaatgctgtttctccaggggttttggagaaccaatgattaggtgcaggccttgggccctcgggaggaaagctgaatgtttgtagtcttctctgctcaagacacgctagtgccttaaggatccagagagcaactttactcagtttcctttctccagttttgcaaggtattggatctcctatggcctcctcagttaggacacaaaatctatgtggattcaccagtgttctccttaattacagaagaacttcagcccccatactagtcgtttcagttgtagatgctgattgtcccccaaatctgactgtggtctagagacctggcctttcctctagcttggcaggggcaggtctggcggggctgaccacccaatgaaggaccgggttgtggggtggctgtggttagtgatgagttatcagtgatggtggctatggttagcttctgcggcagccccagttgggtcagtaagtgtttcgctgctggcttgtgtgggctgctgagaaggcaggaggtataactgggccttagggaagaccacaggcacaaagtccaatggcctggctgcctttcttactagtcctgggcaagtaagcatttgccttgggccagaggtatatattctccatattggggtttctccaaccataatgtgggtgttaatagtgcctctgtggattaaatgagatagtgcctgaaactgctcaagacagcactggcagctaggaggcagttggtaaaagtgagcagagacccagccctaaagatgcacaagctcagctgagaacactgccagaatgttcagctgcctagcagtaggtaagtcaagaagattgaattgggggtcatcagtgcagaacacaaacagatttggctgtttttttccaggttctccaaattggtctttggaacctccttctagggagactggagaaagctctggcactggtgtttgttgagtggatgggaggcagggttgttaacttttcttgccccttctttcctcttaggaatgtttttgactccagtctcggggccctgagccccctgtctcctactgcaggtcagagtgggagcattccagttcagttccactcctcatctggaattccccttggattcattttcaacccaacaggaagtgaaggcaagaatcaagaggatggttttcaagtatgtatgatcagatactgctgtggttagggtgacgccaactgctcttaaaattgctcccttgaagggtttggtcctgctctgggctcacagagaggactgtgggctgctttcaggagtccagctgggcacagttggtcacatgaattccattctcaaggctgcccctccttattgcatgataatgtcccaggtaggaatttaaatgcaagtaaaaaaattgctgctgtgatgtacagttgtcagttacctgggagaaagtgctattgaaggtcacgaatggggttaagagcctggaggaataggaggaacactgagtcttaatcccatttctgtcccttgtgaccactgcagcttggacagttcaccacacttctctgagcctcatttttgtggtctaaaaagagtaagtgcccccctgttattaagagtgctttaaaaattatgaatatctggttatgtgcttatacatatacacaccttatgtgttagtctgttcttgcattgctataaagaaatacctgaggctgggtaaattatgaagaaaacttttattggctcatggttgcgcaggctgtacaggaagcataatgccaacatctgctcctggtaagggcctcaggaagcttccaatcatggcggaaggcaaaggtgggggggcaggtgcatcacatggcgagagcaggagcaagagagaggaggaggtgacacacattttaaaacaaccagatcttatgtgaactcactcatcgccaatggatggtgctacgccattcaggagggatccgcccccatgatctagacaacttgtactaggccccacctccaacactggattacagttcaacatgagatttggaggggacaaacctccaaacaatatcgccctctaaatatatatatagtcatatgtttacttacattataagttagctgatgtgtacatctgaatatgatatgtgtgtttatgctcatatgtttttatacacttatattttgtgtatattttatatattatatatacatataatatatatgaatgtgatatgtaaatatatgcatatatacatatgcacatattgacacatacatgtatatacatacacacatatatataatgttcttcacaagccctcatagaataatgacttgatttgccccttgccactctggtctgtggatccactctgggctcctgctgccccttgtactagtgtccactgaagtcctctgaagtccatggtcacagccatttatggctgtctcctcccattgcaaaggctctgagctctgagggcctttttccagttgcaagcctctgtaggtctaccagtgctctcaagaagcctgaggccccacaatgggcacagcagggactctgggagccctgcaggcctcaagaatgtcctagtaaccctcactgacttttatcttagactctctatcccagccctttcctctgccgtcgaacagatcaagcggcaagtcatcatgcaagaaagtacaaaaggaaagagctcattaatatgtgtttataaaatacagtagtgcacatcggccttttcttcttcccctggagccttgtgcccttggggcctccgagaattggcttcttacagagaacagtctcagccttgctccgtatctttgactaagacacacagtgcaggggcttcctcccagatttgtggaatcactgtctgctcttggtatatttaggaatatgcgctttgtttttgaagcacagtctcactgtgttgcctaggctggagtgcagtggtgctatattggctcactgcaacctccacctcccaggctcaagccatcctcccacctcagcctcccaagtagctgggactgcaggcatgtgccaccacactgggctaatttttctatttttgtagagatggggtttccccatgttgcccaggctggtcttgaactgctgagctcaagcaatccacctgtcttgccctcccaaggtgctgggattacaggtgtgagccactgtgcccagccaggaatctcccccattttttttttttttttttttttttgtgagacgaagtctcactctgttgcccaggctggagtgcagtggcacgatctctgctcactgcaagctctgcctcctgggttcacaccatcctcctgcctcagcctcccgagtagctgggactacaggagcccgccaccacgcctggctaattttttgtattttttagtcgagatggggtttcactgtgttagccaggatggtcttgatctcctgaccttgtgatctgcccgccttggcttcccagagtgctgggattacaggtgtgagccaccgtgcctggccgaatctgcacttttaaaaggcgtctccccaccctcccctgtgactgttacacacgctaactttttaaaaacagctttatggagatatattttatatgccataaagttaacacatttaatgtgtacaattcaatagttttgaatatatttacagagttaagcaacttttaccctattctaatttttgaacatttttatcacctcacaaagaaaccttgtaagtagacattgttccaaagaagatagacaaatggccaataagtacacaaaaagattgtcaacatcattaactattaaggaaatgcagatcagaaccttagtgagctaccatgtcatagccactacgatggctcagagactgacaaaaacaagtgttggtaaagctgtggataaagtacagccctcatccattgcttgtgggatttgtaagtggtgcctgccacattggaaaaaggtttggcagttcctcaaaatgttaaacatagatttagcatatgacccagcaattccacttcaggagagttaaaaacacgtgcacacgaaaatagttgtatgctaatgttcataccagtgctgtttatagcagctccaaaacagaaacaacacaaaatatccaactaatgcatgtataaacaaaatgttgtatatccaaacaatggaatactattcaactgtaagaatgaacaaaatactgattcatggtacagcatggaggaatcttgaaaacattaggctaagtgaaagaagccaggcatagcaggtcatatactatatgattccacgttttcttttttttttttgagatggagtcttgctctgttgcccaggctggagtgcggtggtgctatctcggctcaatgcaagctccacctcctaggttcacaccattctcctgcctcagcctcccaagtagctgggactgtgggtgcccgccaccacgcccggctaattttttttgtatttttagtagagatggggtttcaccgttttagccaggatggtcactatctcctgacctcgtgatctgcctgccttggcctcccaaagtgctggaattacaggcgtgagccactgtgctcggccaacttttttttctttttttgagatggagtctcattctgtcgccctggctggagtgcaatggcacgatcttggctcactgtcacctccacctcccgggttcaagcgattctcctgcctcagcctcccgagtagctaggactataggcgctcgtcaccatgcctggctaatttttgtatttttagtagagacggggttttgccatgttggctaggctggtctcgaactcctgacctcaggtgatccacctgccttggcctcccaaagtgctgggattagaggcatgagtcaccatgcctggccatgattctactttttgtgaagtgtctagaataggcaaatacatgaagataaaaagtggattagtcattgccaggggctgacgggaatgaggaatggctgctaatggtacagggcttctttttggggtaaagaatagattttggacttagatagtggtgatggttgcacagctttgtgaatatactaaatatcactgaattgtacactttaaaagtgtgaattttatgttatgtaagttatcaataaggtagtttaaaaaaaaaatttacccattatatgcagtatgcattttcggaggaaaaggctgttggtttaagtttagggctaaaagtcaaagaccatttgagtgactttgactcaaagaattcacctctgctcttgtctgaaaaactaatcaaatctcaaagaattggtacaaaaaggagcaaggagcattagagatcatctggtatgttttccctcccttattttacagaggaggatattgaggctaagaagaaacaggggccctggccaggatcagtgggttacactgccaatccaataggccccacccagctgtcctttcccacctctcaccacgctccctctcccacaccccctagatgattagttgagctgcttttcagctgtgttgaggtcataactaagggcttgagagcattatttatgacatatgaaatggagagacacactaagattgaggacattgagggtggagaatgaagacttcttatgtgtctgaacaaggtctgctcttctggggctgtgtatgattagcacttatgtttcctaggacaactgtaagtgacaacaaacaaggaaaggaggcactgatttttggccccagttgtggggtcactgaggacactaaaaatgaagacaggctgttatgaatcagaatggaggaacatgggccaaatgggagtgatgacctccccggagcactttgttctttttctacagtgaagttttctttttaaattttcaacttttggccgggcgcggtggctcacgtctgtaatcccagcactttgggaggccgaggtgggcagatcacgaggtcgggatatcgagaccatcctggctaaaacggtgaaaccccatctctactaaaaatacaaaaaattagccgggcgtggtggcgggcgcctgtagtcccagctactcgggaggctgaggcaggagaatggcatgaacccaggaggcagagcttgcagtgagccgagatcgcgccactgcactccagcctgggtgacagagcaagactccgtctcaaagaaaaaaaaaaattaaactttgtaggtacgtagtaggtatatatatgtatggggtatgtgagatgttttgatacaagcatgcaatgagtaatcatcatgtcagggagaatggggtatccatcccctcgagtgacagtgaaatgttagatgcttgactgattaggacagctcaactcaaacccaggacacttgcctttccagaccgaggcagtcccccaaaagtatgttttgaggtagtgaagaaaccactctgacaaccaccttattgctaccttgcaagaagtttaaaaaacattgcagtcaaaccttccaacattgcaccccacgatgacataaaatcaagataagacctggctggtgattggttcctgaatgcacagagctcctggcctgctggctgcccgggcttgctcatttcattaatctcatagtaacacaaccctgtgtttactgtgactgaattttttggactccctccatagctttgtctccactttaccttggcagaaaacggttgatagccttccccggcccctttcaaaccacattaacgtttaaatatggcttttgggttagaattacaaagcattttgtccttttttttcccccttaatattatttggtatgtgcttttacataaagctgtattatttttcatgttgattgtttttaatgattatttaataatccaagttcaggtatcacaatatatttaattattctcctaaaaggtaacatttgattccagaatttttgtctattgctggaaaaaaaagctgtaatcaacatccctgtacctacagtgggttttcttttctttctttttcattttgagacggagtttcactcttgtcacccaggctggagtgcagtggtgcaatctcagctcactgcaacctccgcctcccaggttcaagtgattctcctgcctcagactctcccgagtagctgggattacaggcacccgccaccatgcccggctaatttttgtatttttagtagagatggggtttcaccatcttggccaggctggtcttgaactcctgacctcaggtgatccacccgcttcggcctcccaaagtgctgggattacagttgtgagccaccgcgccggctgggttttcttatgaattattattattgttatttttaagacagggtctttctctgtcacccaggctggaatgcagtggggcaatctcagctcactgcaacctctgcctacctggttcaagcgattctcctgcctcagcctcccgatagctgggattacaggcccccgccaccacacctggctaatttttttttttttttgtatttttagtagagatgaggtttcgccatgttagccaggctggtctcaaattcctgacctcaggtgatccacccacctcggccttccaaagtgctgagattacaggcatgagccacagtgcctggcttcttatgaattatttttcttagtccgtttcatggcctgctgacatcagaatgacctgcaggaaggtgagggaggaggggagggagtgctggtttgaaatctagattttcaggccaggttacagacccaccaatttggactgtcagggaataggacctgaaaatctacatcattaagtctcctgagagatttttatgaacactagaatttgagactagactcaaaagataaacttcttacagtaggctgctgtgggttcattttggtaacagccacccactaggtcctcagaggtgctagacccagtatttcatcctctaacaatactatttctttccccttttaacatggaaggaaactgggactcaggtcaagtaacttttccaagtttacctgctaagatatttcagaactaatatttgagcccctccacctctggaactcatgttcttaattacctgtctgcactgatagcaaaatgttttgattctagccctcccaccccccacccccaaaagttcatacatggcagtcataacccccaagacagtagctgatctgtgaaccttcaacttgcaacctagtttagttcaatttgagagaaattagaaaaattctggtgagactctggcctcagagccccctgtctgggttcaagtcctgccttcgccactcatgagtggcataaccttagtttagacccttctctggactctcctattccagagagctgtggtgagaattatatgggcatatgctaagcatatataggtaaacataggttgagcacagcgcctggcacacgctaagtgcccaggaaatattagcagttactgtcactattctctgagtggggtttcctcgtttgttaaacgtagaaatagaccctgagctcagaacagactcttaggcagaagtgcttcctggagtaagcggagggatttctttttcttttttcttttttttttttttgagacggagtctcgctctgtcgctgaggctggagtgcagtggcgcgatcttggctcactgcaagctccgcctcccaggttcacgccattctcctgcctcagcctcccgagtagctgggacgacaggcacccgccaccatgcctggctaatttttttgtatttttagtagcaacagggttttaccatgttagccaggatggtctcgatctcttgaccttgtgaaacgcccgcctcggccttccaaagtgctgggccttccaaagtgctgggattacaggcgtgagccaccgcgcccggccaagcggagggatttcttctcacttctcagaggtcaagccatggggaatctcaccttaccttggtcgcaagccagcagacagttttcttgtggtaacccttaacagggtgctgaggtagagagggtgacagcattggtatcactgtgctgagcaacgtgaagggtaagtaccgtcaggcctgtgcagtgggcagcctgggctctcatgtccctgaaacttaatttctctgtaaccacaggctgatggttgtgaagagagaggcccagacccattagaaaatctggatgggccaggcgtggtggcccacgcctgtaatcccagcgctttgggaggccagggcgggcagatcacctgaggtcaggagtttgagaccagcctggtcaacatggtgaaaccctgtctctactaaaaatacaaaaattagcagggcatggtggtgagtgcctgtagtcccagctactcgggaggctgaggcaggagaatcgcttaagcccaggtggtggaggttgcagtgagctgagagtatgccacaacactccagcctgggtgacagagtgagactctgtctcaaaaaaataagaaaacaaaatctggctggaacccaagccttcccctgaaggtggtagatggaaaggaaaaacagtttaattctgaaggggccaagggcagacccctgtgagaaacagaaaagagtatggggaacaagcactttttcttttcactcctgaagctgtgagcctgtaggagtgataatgatcagatggaccacaagggaggggaggctttggggaaagaaggcaaggactggtttagaacctcaggatccaagaacatagccaggaggccatagggctcactggccagtgggtagaggagcaggttgcttcaaagccaccgaagcaccttggctttggatgagaagaaagtcttgtgagcatttaagcaggacagtttagaacaggagttggcaaactttttcagtaaaagttgtatagtacataattttaattttcaggccagtggtctctgtgtagacagtacctaaatcagtgagtgtggctgttttccaataaaactttacaaaaatgggcagcaggccagattaagctgagccctggagaggaaagagtattggcttcaaattcagccagactgggcttaaactccagttccgacctccactagccagatgagagtcaggtgccttcacaactatgtaactatctgtttaagaacttgggctttggaagtggagggccctgggttcaagtcctgccttcaccactcatgagcggcataaccttagtttggccccttttctggactcctctattccagagagctgtggcgagaattatatgataatatgctaagcatatatagctaaacatgggttgagcacagcgtctggcacatgctaaatgcccaggaaatattaccagttatcactattctctgagtggggtttcctcatttgtcaaatgtgggtaagattagtaccttttaccatggatgtaaggattacattcagtaacaggtgtgtgtgtgtagtgtctggcacaaagtaaaatgtcagcgctaatattatcctttagaaatggaagccattctgccctcccaggagccctggaggaacactctttttaaacacaagagctctttggtgaaggaaacagtattagtagagatcagaatcgggttggtggtcttcggtatctaatgtgtgatccagcagggtgtgagaggagttgggggcgcttgggagtcagtggcgtgagtgtagtcttcctcttcggagattcatccatgttggtatgctctgtttttctttgataagcccattgcccaagccaagctctgctcgctagctccagaacacaggttacattgcttacctgtgtctttgctttaaccccttcctgtaatcagaatggcctcttcctttcctcatcagctgattcaccaagaccccatttaaaagctttttcccctctgaagcctgctccctgacagctccaccccacaatgaatctgctcctccgaattcctattatttgtatccttgcattcctttttccttgctgtcttgtagatcccatttcttcaactagactgggagttctttaagggatgggatcgtggttatacttcctggtctccatttcactatcttccctctagtggatccacagtaaatactcacaggttgaaaaaaaagtaagtaaatttttaacccatgcaaatgtcaatatatgtattgtaggcaagactgctaattctaggagttgtcagctcttgttgacactttttaactttatggagcaccgcaaagaaaactgccatttaagagcttgcttaagttagaaagcaataaaagtgaagaatattctaggcctggtccataaatccttcccaagcacaatcttcatgctctttccttgtcttcctgctgaatggagagcattttgaggactgaggggaaggtggaaccataacatgaaaggagcctggattcctgagtagctgcttggaggggagccaaccaggagagatgcctgggcaggaggactcatgtcagacttgcatgagaagtaaaaacacacacacacacacacacacacacacacacacagcaggtaatgcccatgcgtcttgtcagttggatgttttctcattagaaaaatgactatagttagggctgaattaaaggtaggcattgccttaatttatggttggtacaatctgagtgtaaatgtgtcccccatctagaatctgtggttagtcactatttcagaataatgctcccacagggttttctctgtgtgtactgttgataaccacagtaattccatcagcctcacattgttgatcatgtttggatgggctaccatccgctgaatggtttggctgcaacagggactgactcacaattccgtaacctaaaatccactgtagtgagtcattattttctgtccagctgacactcaaagctggcagtcctctctctgacaggacgcttacaggagcctcctaatttgagatttagcagagatcctgctctgggattccaggattggtcaacagttcctataactgagctgtgaggatgagaggatctcaagccacagcaaatagaggaccattggcatcccgatgagatgggacccctgtaacctgccctgatctggaggtggtcagacagctcagccttccagctcccaaccctgaatttggacatggcccacaaaggcctggatcacagaaaagactgtcatcacacccttgccttgaagccctgtccttcactcttatgggtccttcctcacacagttttcctaagctcattatctgctttcccaacccaggatgttgagctgtaacaagaagatgatgcagggatgaggagatgggaggcaggtgttagacaaatgacaagagctgtcggcccagagtcatcactcggggaggagaaaaacacacccaacacacaatgacattatgatagaatacaacagagatgtacggggtgaatctcaagtgcatggaaaaaataatttctgttcattgttgttgtggtttagatggtagaactatcactttcagcctctgctaggagaaagctacctttcgctaataacggaagagctcatcgatttcagactctcatcccaacttcacctccccacatcattcacttttctttcttttttccttctgggtgtgcacagaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtaagagcctcagtcaccctggatcagccctcaggtggtcagcctggggatcgtgacatggccatgggagggaagggaggggactggaagagccgtccaggtccttccctggatctgtcttttcctcactttgccattttgactccagtgcacaggaagctccaatcttttggagcctgtatttgcattgattttggttttgtttgaaaactcagttgcaagtgccagaaactctgctgaaatttatttgggcaaaaatggaaattcatggagtgatctcattcactgggtgggatgggggtccctcagggtgtgcaggagccagggacttcagtgtcatcgagattcttccacatatctctgctgttctctgcctgttgcctcctctcgtaccctgactttattaggaagctggaactggagctgtggacggtgcccagctcacgtcttcagagctccaccctggagagaaaagacccctttccacagtttaacaatccaataaaatattctaatcagcctgaggcagagcccactcttggggccaagggagtaggagtctgactggccactccccctttaccccatttgtctagctgctgggcaaataggctttcctagaagagaggagggtacagatccttaatgctctcaaaccaaaaaatggacgtcacttatgccatggaccaatagttattgtgagcgttaagtgaaatgactctggtctgggcactgtgtttgcacacagaaatctcttcattaattttagtacattatttaatttctcagttaataaatccagggttgtctttctcatgctgggcattattctaggtgcttagaatacagagacaataatacaaagtccctgccctcatggagtttccattctcagaaaggaactagataataaataaatacataatataatttcaggtggaagtaaaatgcaaaagggaaaaataaagtagggtaagaggctaaagaatgatggggaatagagaggaaagctattttagtttgggtggtcagtcaaggcttctttgagaaattgatttttgagcagaaacttgagtgaagtgaggagtaagccttccaaatatcaggggaaggcagggcaaagcaggcaggtgggtggtaagtacaaaggccctggggcagcaggtaggctggcgagttataggaaggaacagccagacggccagggaggggcggaagcccagcaagcaagtggcagaaacacaagaagtaagggtggaagagccaggagtcagccacagagacttggtgggcatggagaagatgttagtttattgtgagtaggatgacagacagcctttggagggttttaagcaggggaatgatatcttcagagaatcacattggctgctgtgtacgaaatagactgacaggataggggtgggagaggaaatagtaaggggagaggggaaactgattaggaggcctttggcatggctcacaaaagagatcatggtggctcctagagggaagcagctgcagcctcgacttaggatatgtttgttgtttgttgttgtttttgagacagcctcgctttgtcacccaggctggagtgcagtggcgccatctcagctcactgcaacctccgcctcctgggttcaagcgattctcatgcttcagccttctgagtagctgggattatatgtgcataccaccacacctgtgcacgccaccacacctggctacttttttttttttttaaatagagatagggtttcaccatgttggccaggctagtcttgaactcctggcttcaagtgacccacccgtctcagccttccatagtgctgggattacaggcgtgagccactgcgcctggcgttggcttaggatatgttttgaaggcagagcagtgagcggccgccactgaattggaggtgggtgtgtgagagaagaattgaggattttgacttgagccccagagtgaatagtggtgccatctcccgacatgggaaagatgacaacgggggaagagcacgggacattgtgttctgtttcagacagaggaagtttgcggtgcacattgtacagctcagtgtgggagccgagcagacagttgggtgtgagaatctggagcatggaggaggggacaggcatggagattgaaatttgaggtggtttttaaatctgatataaggtcacctaggtagtggggacagggagagaagatgaccaacgggccagcaagtgcaggtcagagagaggaagaagatagagtgatggagactaaagagcggccagtaaggtggggacatccaggattgtgccatgtcctggaaatggtgatgacatcattgtcatcaatcattgtgatcagcaagttggcatttaacacagcctgccttagccttcattggctcattttgtcttctcaaatataggcaatacaaactcctggagagaggagagagggactttgcctcatggccctctgcccgccgtttcccacattgtgccagacacagtgccttgagcatagccattgccaaagatttgtccatgagggtagaacccaccacacggtgggaatccctgtctccttccagtgctttcttcttcagcaggtagctggaacagtgcctctcaaactggaccagtattttgtttttttggttttttttcccccagatacaccatggactgataactttttaaaaatacaataaaaatgaggccgggcatggtggctcacgcctgtaatcccagcactttgggaggccaaggatggtggattacttgaggtcaggagtttgaaaccagcctggcaaacaggatgaaaccctatctctactaacaatataaaaattagccaggcatggtggtgggtgcctgtaatcccagctacccaggaggctagggcaagagagtcacttgaacccaggaagcagaggttacagtgagccgagattacgccactgcagtccagcctgggtgacagagggtgactccgtctcataaaacaaaaataaattaattaggggaaaaatgaaataaacacaatataaattcaaatgtttattatttgattcagcagacataaaatgactgtctcatcgctgtccagttagtttgtcagtgtttcagtgtctgcgcttgtcccctctgcaccagcgtttaatgcttagggagctgctctgcccacccattgctctttgagcagccatggcctagagagatgagaagccattccttgggagggggatggcctgagctgagggccatgtagggctcccaggaccacctgacccacccctccccactcccaccaaagggctgagtcgctgttgctcactggttctcaacgtgtgctccctggatgcagtatcttcgtcacctgggagcctgctggaaacgcacagcctgtggccccacaccactgaatcagaaactcagagtcagagagccttggtctgctcttcatcctgccttcagtgactctgatgcccaccagagtttgagggtcactgccaagggcagcgtgaaactctacaagcaataaagcaaaaaaactgatactggttcagtctctacttttatttttttgagacagggtcccgctctgtcacccaggctggaatgcagtggcacgatcatggctaactgcagccctgacctcctgggctcaagtgatcctcccacctcagccacccaagtagctgaagtagctgggaatacagatgtctgccacgacacccagcaattttttttttttttttttttttttttgtagagacagggtttcactgtgttgcccaggctggtctcaaactcctaagcttgagggattctcccgcctcggcctcccaaagtactgggataacaggcgtgagccactgcacctggtctctttccgccttttgagccccttctctgacagttctcagctctggctcagcatctgaattacctggcagcttgtaagaaagtccattgcagggctggggggctccagggctggcagcactgcctgcagaccgtggctgtgcaacgcctcccctgtgcacatgtgccctcagggctcagtcctgggtcctgggaggagaatctgttttatgtgcattcagaggagaatgggaagttttacagacctgaattttagaaatgaatgggatttttgccctatcgtcaaaccttggtccaccctgatgacttttcaaggacaggattcttctagatacattactgactgcacgtcttttttttttttttttttttttttttttttctggagacagactctcactctgttgcccaggctggattgcagtggcacaatctcggctcactgcatcctccacctcccaggttcaagtggctctcctgtctcagcctcccaagtagctggaactacaggcacccaccaccacacccagctaatttttgtatttttagtagagatggggtttcatcatgttagctaggctggtcccaaactcctgacctcaagtgatccacccacctcggcctcccaaagtgctgggattaggcgtgagccaccacaccccccctccgactgtgtgtcttcttaaaatgaggtttctcaacatcgcctaaccctttcttcatgtcctagtgtcaccatctgtacatcattttcctcctggcacaaacagcgctgccctatggctatcgaggtgtgctggccgcttcctctagatggcctcctattgctggccttggagttcttacgtccattgtttatcattcctcagtctttttttctgttaccagctatgcttgcttgttctttgcttgctgtcacctcgaaccactttctttcatttccattccggttaactgttttcctcaccagctatgggtctgacaaaaccagacactaaatctgtgctgccatccacaaggaacccacggcctagaagatgagggggcaggaggagggtgggtataggaccacaagctgttacaaccccttggcacaggtgggaggagctgcatgcactggccagcgagcctagagggcagcacgtgctgttggctgagcaggtggaggatgccaccaacggcctcttcagcaccctcagcagctcggccatctgctccagcgccacgccaggtaagatcttccagcctggagggagtggaagtgccatgtggggtcggggagggctccctgaggcaagaggtcaggacccaggagcctcccaaggatggagggcaggcaagagaaacagagaccggcagcctccaccctggatgctctgcgtctccctgtgccctgccctgtgggtttcccagctgggagccccgagcttgtcttcatggaggtagaggggcccagggtttgagacccaaatgtagtaggttccctgtcccctgctcaagagacagagccaagtctcctccccctgccttggaccacacagaggagcacaaggaggctttgtgcttggtgcgagatccctgcattctagtcgtccttgtcagggtccacccaggagccacattgatgacgttatgtggaatgtacatgtgtgcccattacgcaaaagctgtgtggggtggggcccagcagaggagatgctcagagactggatgccccgctgaacaggcagagcagggcccttcacccagagatatgccctgacctgagagagcagaaagtggccagcctggaagtgtggtggaacctcccaggagcgggagcagctgctggggaagcgtgtgtggcaggaggaggtggaaccctgtctcctccgtgggtgtgggtgtgtgttgtggacacagactgcagggtcgaggctcacccctgtgagcacaggacgctggagatggtccgggagttcgctggcaatgccccatgctggagaggatcgcggcggacccttgcggtgctggctgcacactgtcccttctacaggtttgtctgcgcggtctgggctcggcctgggtggagatgaaggcccccacccctgagctgcggggaggatagtactttggggccctgccatggagattgtgacagggatcgaaggagacctgggagggagccagggacgtagccatgggagaacagggagaggcacagctactcagtgtcagcatcccttaacacacagcccaggtacccagggtgagcactggtggcagggtcacaggcattctggaaggctggtgagtgagccaagtgctggccctgcagggcggtggtctgcacttgggatattgatttggtaatttggttcctctgagcaccagtttccacattatgggggctgagtgaggcaagaggatagagatcctcagatgaattccagtcagggaggctatgggatgctgggttctttgggattggagcccaggcacccaagagcacctgctgcccgtctgcccacccatccctcccaaacactccccacactgttcctgggcactttctttagactacctgccattcagcacctctgtccggagactggtgaccctgcccctctccctttctggggggccggggcagtgtttgaatcagctgcatctttacccattggtcctcccccagcgatgagctcacagcacagcacacagcagtgaaatggattggctgagaagccttagggctgtgctgggctgatggagaatccaaagactgtttctctgggaaaggccagccccctacataagggtcagaggagatgaggtctcatgccactctggggccaccagaggctctcctcagaacccaacctctcaagtgaaaggaggagttgattcgttccttggtggccactttctaagtgcctgctcagagccaggcaatgtgcaataagaagacagtacagttgctgcccccaaggaatcatggtttagaggagggcattggaaaaggagaccagcggccaccctgaggcatcctaggtgttgggatggagtctgtcctctctgggatgtcacagagaaggggctgctcgagcagttttgcaagatttggaactgtggcagtgggcaaggcgctcagagccgggagcggctggaagaggctggtggctgcagtgtatacttcctgggccttgcattcagactctgctctcaggctgctgaatttttaatcttagcagaaccactagggagcggtgaacttaccactgcatgtttctatgtttgaaaaggggtgtgataataatcatacctgccctacaggtttgttgagaacaggcggtgatttaataggtagatgtgttaatattgcaggctcctagaatgaagcatttgggagctcttcacccatttcttcactcaagaaatacccactgagggcctcctgtgctcctggcactcacccaggtcctgggaaatcagcaccagcatctcagaaacacatctaccctcacaagctgacgctccagtaatgggaggcagtcattccaaaatgaatacagaaaataaactgttcagtggtagcaggtgctgtggaggaacacagcagcaagatggggatgcggtggggtaggcggggggttggggcaaggtcacagtttgaaatggagtggccagggagggccttgcagagcatgtggcatttgtgtccagacctgagggaggtggggggcaaactgtgtgcaggtccctgcaaagccctgttggtagtgtctgctccataaatgctgattcccagggaagcctaaatcagggagggggaagggcccagggatctttctgggctaggacttgtggctttatgaggtcactaggatagacatggaagagaagacgatttctcttgaatgagctggcagtttggcaaactttgtttttattattatttttttgagacaaggtcttgctctgtcaccaggatggagtacagtggcagaatcatggcttggtgcagcctcaaacttccaggctcaagtgatcctcccatttcagcctcctaagtagttgggactacagacacgcaccaccgtggccggctaatttttaagatttttttttatagatggggtctcactatgttgcccgggctggtcttaaactcctgagctcaattcctgcctccgcctttcatagtgctgggattacaggcgtgagctaccacgcccagccttggcaacctttatttcagcaactccatgagctctgaattgacttggcgtgtactccattttaccccagggaagaccctgccctagaggagcacctgattggcctgcccctgtgtgggcagcccagggtgggatcttgttggaagaagccttatttggagaactttagggaatgtttctgccaaggcccaagagtctcctcaggtgaggccatcccaggagctgctgccaacccagagtggggctttctgcccccagatgaggaaccgctcctgtgacagcagggcacatggccccggagacgcaggagaggcgagggtgaggcccacagggtagagtggggggatttggagtcatggtcagggtttggatcccagctctgctgtgttccggtaattatgtgacctcaggggccctaagtgagccctcagaacccatttccctatctggaacatggagggaaccatctcttcaggtagctgtggttcatggaacaccagcaggtggaagccacccaaggaatggtggctgctgtgttatcacagaacgttagttctccagcagacctgagaagtcattgagtccagtggcttacatgtcttgacctgcagagcctcgtgtggacacttgttgtgtggaccagatagtagcagcacacctggggtggaggggcggggctggggcactgcgggaggcctggagccttgctccttcagtgctcttctctccccatcgaagctttaaggaatacagttgaaaagtgaagatagaattactatacaaagaggaaagtgaagaccagaggaggaaagtaacatgtctgtggtcacacagccaaaatccagttgcccagttcccaatatttctctccctactgcatcgtaagcctcagaaagtaacttataataaaaagctgttgctacagtttggggttttgcatgtggatgtccctaatttcaaatgtgatagccagcttatgttaccttttttttttgagatggagtcttactctgttacccaggctggagtgcagttgtgcaatctcggctcaccgcaacctctgcctcctgggttcaagcatttctgcctcagcctgctaagctgggattacaggcacatgccaccacgcccagctaatttttgtatttttagtagagacggggcttcaccatgtaggccaggctagtctcaaactcctgacctcaagtgatttgcctaccttggcctcccaaagtgttgggattgcaggcgtgagccaccactcccagcctattttttttaattgtcactggatagtttgaaacattccctactctatgtgcagagaaaagttagggtagaatcaagaaacaaaaccaggaagtctttcttacttctgcattggaatcttctatcagcttttggtgttgtaaatcatcttctgttttctgccctccccttacacctctgatctgtctataattctgtttccttggattgtagctggaagagagtgttcctaacccaccctgccacctgctacaggaccacctgcccaggtatggtctgtctcttggatttacaggttctttcagggccctgggcccaggctgctttgtaaagtggcttttacaatcctgggacagagggtggggttgtgactggctccagggcagagggatggggcacttggggggcagaggagagtgtgctcttgactccctcaatggtgtttgctcattaagaatggagtggcggctttgggattactcccctgaaccagtgttgtgtgcattggtgagaggcagagaggcaggcaccgagcaccagctttgcagacatcctcaaagccagcaccaaactcagggcaagatatctgagtgatttcctcctctataaaacatagtggtttgtccgatgtctggaagcccatttccctcctccatgtgaaagggggtcatcgtatatgaggtcctagtgaagattcagtagataatgcccatggaagtaatccctcagctgtaaaatcccaaattaacgtgaggaatcatcgatgccattatgcatcattcagcatggttcaccagtgtgccctcactatccctcacttggggtgctagtgaccccactgacctgggagcttgaaattgcccttcaatgtgtaggtgtcagtcctggggtggatttgttactcccgatgagtagcctgtctcccggaagcaatgccggcagttagacacacaggcagggcagcgagcagttagacacacaggcaggcagggcagcgagcagttagacacacaggcagggtagcgagcagttagacacacaggcagggtagcgagcagttagacacacaggcagggtagcgagcagttagacacacaggcagggtagcgagtgtccctatttggggttaggtgatcccttcagtatgttcacaaggtttacagttccagcaccacggcctctgaagcacaggagaatctgagagtggagctgtttctgctcagaaattagggtttgaggacttccggtttggaaactagagtgaaatggctttcagtcccagctttgcctcttaccaatgatctgacctggggcatgtgacttctattcattgagcttcagcttcctcatctgtcatatagggtttttatagttcctacctaaggttgtgacaatgaaatgggaccatgcgtgtattgtgcttagcacagtccctggcacataatagatgctcagttaaaggccactgtcgtcgatctcagtgagcccccagctatttccacagtcttctggctgatacaacagcagccccagcgaagtgcctagacttagcctcaatcttttctgcctttgaaaagtctatattttaattacaatgatgtggccatcaagaaagagattaatatttgtaagcaaaaaggacaagaaaatgccagtcccagttgtgaccacactcagctgcttatccagctcttggaatacatgatcacatgaagaccttgtttgttttctgtaaccctgggaaggaggtcatgtggttttagctgcactttgtaataattgataaggaaagcaatgagatgctcaggcatggaccacagggaatcatagatcagacgcttcagaatgggccacattttgacacaggctgtggtttcccatgtaaactttcagctttgaagaggccttgctcataatttgcatctcacatccaaaagtcaatactgtcattacctgttggggagtgtttttttagtgctgagactttctgcggattaattcatttaatcctcacaataaccccacagaacaagttcagttcccatcactcctttttagatgaggatatgaagatgggagaggttaattaaggtgccggaggaagtggaagaggccacattcagtcctgagcagcctgactgcaggatccgaaggctggtgtgttttgctgtgccaggtgcagaggccattaagacaaccctgtgtagaacttagaagacagggccccattggcaccgcagctctctctcagtcttgaggcacccacacttgatgctacggggagcttcctccttgtcaagcttcagtctaacaccagttcatcacacagggccttaccaagcctgctacagagcatcctttaccacccgtgcccagcccctcctttatgaactccacagtgctttcccctctctgctgcagatttcctggtggactgtgggggaagggaggggctgggccactgctagagcaggaagccagctgcacccacacctctggccagtcctctccactcctctgtgctgcggtgcttagcggttaatgggcatctctctgataggcccctgtgactcgcagccctgccagaatggaggcacatgtgttccagaaggactggacggctaccagtgcctctgcccgctggcctttggaggggaggctaactgtggtaggtatgcaccggccctgcaagactgaccactggggagcaagaagaggacgggctccccttttcattgcacgcccttccagctgctgggtagaaactggcccttgaaccatctgctttccaatgcaccactggtctgcagttcacgtggtgcagcctgtcagtgctccgtgagtagataattggggtggctgagctctggatgagacagtggctcccagcttattagctgcagaatggtcactgcttgaagtttgagtgctgcccagcccagctgaaggcaggagtccacccaactctggctcccagtcctgggcagagtcttttcttctctattctatgaaagcagagcaaggagccccgattccttttgattttagaggtgtgaaatgaagatgatagtaggctttacctcactgggtggttgagagttttaaataagattatgcaaagtgcttagtaccatgcttgacgcatataagggcttgatgaataataacttttaaaaacaagtgatactgggttagttgaagatctgtatgaaaacaatcttgaccctgtacctcacaaccctaccagaagtcaattctagcgtggctatagacctctgtgcaaaaggcaaagcagtgaagcctgtagaagcaaacacaggagcatatattttcatgatcttgaggcagacaaagatttctcaggacacacacaggactaaccataatggaaaaaagtgataatgtagatggcatttttctttaaaaagtggctagatggagacccttagcgagtgccaggagtgccatgtctggccttgtctctaactctgtgacgagcacgggtcacttaagcttggggggcccacagtttctctgcaccatctccctcctgggagatgttcggcatctcgggtgggacagctcgcatgccgcatgaccatggcttgacagtgggtgttgctgtgatccccgcagccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccaggtaaggtcccagtgcctgacccaggaccgctggtcagtgggcgggtccttcctccttttggccaccacctaaccatcattttctgccagtgcctcttctaggggctgaaaccacagccccactctttcaggcaccagtcacataaataattttcagtttacctgtcaacaaaatgggactaatagtagtacctcctgagagatctttagtgagaattaggtaagatgggcagtgtacatgcttagtacagagtaagcactcagcaaactctaggtgttgctgttatcattcttaatcacgattttattgttgttgttactaagagctctgaatctactaagcaggctccagagcagcagcttcccagctcctttgatggcaatccacagaaaagtgtgttcctggtgcacacatgcacatgtatgcacacatacacacacggatgcatgtgcatgcacacgcgctggtgcagccacacacaactgaaacaaacgcttcctgagaggatacttaccctgtctacttgggatgcattctgacatttttctcttctgttctgttttgcaagccatgaagctgattttttatgacccctattggaaggcactctagagaacactgtccccacgcagaggcctggcccatggccagagatgtagtagctgaaacacgtcttttttttcttttgagacagggtcttgctctgttacccaggctggaatgcagtggcacgatcatagctcactgcagccttgaactcctgggctcacgtgatccttccacctcagcctccagaatagccaggactacaggtgcacaccaccatgcccagctaattgttttattttttagagagatgtggtcttgctatgttgcccaggctggtctcgaactcctgggctcaagcaatccacccacctcagcctcccaaagtggagggattacaggcttgagtgaaatgtaagcctttatagggctcctggagttctccccttggtaggtgggcatgggaagctacagatgtgattctgcttctcagccctgatgccaccactctccccaaggcgagaggctttccctcctgtaaggcggaaggacagggattggctgcccactcccaccctgcccctccaggctggtctaagtgcttttgttctgctgctttgtttggttggattttttaaaaaaaataatagttgtagatttataggaaaaaataattgacaatagtggagagttccctataccccacacccagtttcccctcctattaacaccttgcattagtatggcacagtgttatcattaatgaaccagtattgatacatcattatttagtgaatccatgcttatttatatttgtttagtttttacctaatgtcttttttgtgttccagaatcccatccaggaccccacagtacatgtagtcagccgccttccccgtagctgtgatagtttctcagacgttcctggtgtgggagtggttttaaaaaccagtaatcagagcatcagctcctctaactccatacttagaatttccagtggttcccctttgcacttggaataaaacccaaactccttcccctggcttctgagagctccctgtggcctggtccccacaggcctctctgcatcccctgcacaggagaggccttctggctcatacttacttgtctttcagttcttaggtgaaatgtcacctccccagagaagctctgaccccttctcccagtcttgttatgttcccctactggtctctctcgaagtcccctgcttttccctccacgctgccgacatcatttgtaattctatgttcatttcatgtctgttcccctagactgtcagcctgttgacagcaggcatgggcccattttgtccatacagcatctaattagtgccctgcatactggggatggatgaaggcacaggtgaagatgttgtcacaaagggttgcccacaaacccaaaccccatgggttacataagacaggaacttatttctctcacatacagttcagaggtgagtggcccgggccagcagggcttggtcatcttatggcttccaccttgaggtccaaggtcaccatttctcagccagcaggaagggggagaggggaagtggaaggtaagcagcttccagctgcatgagtttgaaattgatcacgtccgtcagatagaacttagacacgtggccaccctagctgccaggaagtctgggaaatgtggtctggcaggcactcatcttcctgctaatattctaggaaagtgctgttctgtggctaaaaggaagacatagagggtgtattctgcagtgaacagagcaccctggctgaccttggtcctacccaacctggcagtccctgggtcccgtcgaggggctctgactggcacatccactgctgaagcccctctgcttgctcctgcagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggaggtgagtgggggaatccacaccctcagggctgcccccatggcaggccctcagcctgagccttcacatacatcatgacgaggatggcagctcttcccagctactgagcacttgcttcccaagtgccaggttctgtgctaaaccccatgctcacataaaatcctacagtaggcataaccatcctatttgacatttaaggtacagaaagtttaactaacatagataactccccccaaacttgagaatttatgcattccctttaaacagaacacacttttagaatatccacaagcttcctaagggtctaaagatcccacattcacactgacttgggcagtgacagagcccagagcaaacagggccaggccagcccaaatccagtgacctcctcttcaccttcttaaaagagacaggagaatcacttgaacccgggaggtggaggttgtggtgagccaagatcgcgccattgtactccagcctgggcaacaagagcaagattctgcctcaaaaaaaaaaaaaaaaaagtctgccatgtgtatggcacgtctgagcaatggactctccatgagtctgtaggagagctgggtcttactaacctagccaagtggtatgcagcaccaaccatgagctaccggggcaaagggagacatgactctagtagccttgcacctctactgggcttacttagggtaggggtcttcgggtctaacccatgcctggccggcctggtgggtatggtgttctccattgtagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggtattgcgagtcctgccaagtcccacaaactcagctgaaggcaggttctaaaacattcgttcagtggaagaaattattcagtcgtttacccacgaaacatttagtgagtacctcctgcatcccaggcattgttctcagtgcaggaacatagcagtaaacaaatgaataaaacctctgccctcatggagcttccattctaatgggaagacagacaataagcaaataatacaacatgtggtgtggtagacggtgctaagcaccccggagaaagtcatgacaactaggagggaggccacagttaggagcacagtagatccagggtacagggatgtagacggaggcagggatgggtaaatgcggtggtgggagctgctggaagctctttttggggtgctatttgctcagtaaaatgggaggaacagctaagtgaggacgaggaggaggtgctagaggtttgagagaaaagaagtcattgtcaagggtaacagattaggacctagagagtgatcgttgggaggcattagaggtccaactatggctcctgttcatgagtttgaagttagaacagccagaaatcagaagacaagtccagtcggagccttggttttttggccacgggcagaggttggcttcctaaggccagagagaagctctggaggataatcacatggggtctctaatctggcatcttctgctgggggcgaggtgggttgtagagtaagagcaggacctgaaggggtcctcagaggctgctggagggctgagaaggggatgcagacactcctgtcctcagacttcacttccttccccaggattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgtacctgctgtgccttgttgaggctatgtcatctgccacctttcccttgaggataaacaaggggtcctgaagacttaaatttagcggcctgacgttcctttgcacacaatcaatgctcgccagaatgttgttgacacagtaatgcccagcagaggcctttactagagcatcctttggacggcgaaggccacggcctttcaagatggaaagcagcagcttttccacttccccagagacattctggatgcatttgcattgagtctgaaagggggcttgagggacgtttgtgacttctggcgactgccttttgtgtgtggaagagacttggaaaggtctcagactgaaatgtgaccaattaaccagcttgtttgatgatgggggaggggctgagtgtgcaatgggcccaggtctggaggggccacgtaaaatcgttctgagtcgtgagcagtgtccacctgaagggtcttcctttcaaaagaggctgcggccagagactgtggctcatgcctgtaatcccagcactttggaggctgaggcaggtggatcacccgaggtcaggagtttgagaccagcctggccaacgtggtgaaagtttgtctttactaaaaatacaaaaggtagccgggggtggtggtggatgcctataatcccagctactcgggaggctgagacaggagaatggcttgaacctgggaggcggaagttacagtgagccgagatctcaccactgcactccagcctgggcaacaagagtaaaaatctgtctcaaaaagaaaaaaatgtacttaggaggggttaattgtggcgtgtttatggaattctttccttattctccttttagtggggcaaagagaagtaagattcttaaactcaaaaatataggataaagaaacttacagagattttgctttttaaagcattgatcttacgctgtctaggttttaattttgttttgctttgcttttctacacagtttttaaagaaatatttcaagaaatgttggttatttattaaacagggatatttgtacctatgtggcaaagaggcatatttggaatattctctggcaaactagatacttacttccctatcgctgcagtatttaggaattacttcttctccttggttgtgttgtttagagttggattttctgtagaaatctttctagagctctgatgtgactccagacactttatcgtttttcttttttttgagacggagttttgctcttgttgcccaggctagagtgcagtggtacaatcttggctcactgcaacctttgcctcccaggttgaagtgattctcatgcctcagcctcttgagtagctgggattagaggcaggtgccaccatgcctagctaatttttgtatttttagttagagacagggtttcaccatgttggccaggctagtctcgaacttctgacctcaggtgatccccctgccttggcctcccaaagttctgggattacaggggtgaaccactgtgcctggcccatttttctttataaatattgtaacataatgttttatagacaaacattcaagggtactttggctttaagaacttcaggatttctggtgctagaaaagcgcttgaagcagtatcaccaagattttagatattaaaaagtctggtgtaccagacattgagtcataatcatctatattcaagggatactttcattgataactttgttattatgctgcccttcacagaagacaacgtccggggcaggatcacatgctccctagcagatgctgatcagtgatgtcatagaaattacatgaatgcattgtctttaaatagcagtttaaccatgttataatgtaggctttttgtcttgttccgggctggtatttgggtgccctgattgaattacttggatttaaacagcaaactgtgggctctcgacttacatagtaagggcctttactgtttctttgtaggaaatgggtttctcgcctttgaaacattttttccccttttgtagtgacagtgccactaaatagttcagcttttgtcagtcccccaggaaagtgctatcctatggcctaactagccaagccttttttctttcatttaaaagaaattagctttaatttttacctttaattacttattcaaataagacagaaatatattttccttgcaataattaaaacattgcatataggccataaatttccttattttctctgaacgatcctgattccagtcatcttgttgaataccctagttctaataattgactcttgcttttctagagaaatatttccaaatgatgctagttttgtctcttcctttcaaagttgtataccacttctttttcttgtcattttgcattgcctgggacctccagaataatgtttcatgaagtagcatgtatccatatctggttcttgactttttcatcataataattgttttctatgggttacttatcagtttaagaatgcttaattcctagatgaactaagagtgtttattacatgttgagatttatggtatgctttttcttcctcaagataatgcattttttgtattatctgttaatgtgataggttatccatttgtgtattttcaatcattgaacaacccttgatttttttggataaactctatttggtcattatgcatcattctataaaccctgctgaatttttcatttgccaacatcttatttcagattcttttaatctgtgtccaacaatgagatttgttttcttttgcaatttgttttgaatttttggtatcagagctatactaaccttataatggaaaatacatatttctcaaacttttacactgatatattcatagtatttttttataatttgaaaaatcttgtcagtatctgtattaaggcctccatttcagttctgctatttcatattgccttaggttgtctatttgtctctttaatgaacccgattttgattttgtcatttttaaaataaacacatttatgctataaacttccttaatt

SEQ ID NO: 284 - DNA, 228336 bp, Homo sapiens
  source 1..228336: mol_type = genomic DNA
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacaggtatgttagctggaaggcgaggtctgggacgcgagcgggttcgggtttaccgctgcagtttccgagttgaattcgcttatttcaaagcatgttaactttcagaatggaaaaagggtgtgttgcggggggggggggggaggaaataatgttttattctggaaaggattcttaaaatacaggaagccttttaaaaatgcagaagcaagtagcttttgtcattgaatagaaatcaaatagcccgctaatcacatggcactttttaaggactgtatatgcaatagatgagttcgcagaagaatgaggtgaatcatttgtggttgaatagattgactactcccgcttttggcatcctctgatatgtgtctttttggtgccatttatctgtttgctgttataatgatgcctacccaaaaataacatacagcctttagaatgagaggatacatctatgagttttaatcagtgtggtttcgttattgaaaatcgagaggaaaaatctgagattttatcgttacaagacatgagctttgcaaatgagagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatctgcactctgccattttttgttttatttttttaaaaagcattttattactaatgggacactccctctccacatgcattctagctatttgagggctgcttcttgttattgacattgttgtgggtttttctcttttgattttaacatctccacttgttgaaatctcctttaaggaacaaataagattaggaagactttaggcagtgcactgatactcaaatttatgtataagctgagaacaaattatagcagaatgggccatatttaaaaataaaagttgacaaaccatatgaaacagtgctgatgagtatttccattatagtgcattagatagtcacatctccataatttgtttttatacacttagtagaaggtaaccataagtaaaagcataaagtttgtttttcattgtcatcagactctgtcctcctcagtggcaggcccttctctcattctttctcttttccctttcaattaccaagtcagcttatttccctagcacactcttctaagccttctgtaccccattcaaagcaaaaatttattcttgccgaaaaagcctatttcagtataaatgttggtatagatatataaaatataggacaggttcagagtttatctaatctaattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgttgcccaggcatgtctcaaactcctgggctctagccatctgcccaccttggccaaagatgtccacatttgagaatatgttaccttatgtggcaaaatggactttggagatgggtttaaggattttgagatgaagatattatccaggattatctgagtgggtgcagtgtaatcatgagggtccttaaaaagtagaagagagaggcagaagagattagagaagatttgacagtggaagcagggttggagtaatacagtgtgatacacatccacccttgggaggctgaggccggagaatggcttgaacccgggaggcggagcttgcagtgagccgagattactcaacccatctttgctagctttggtgatgaaagaaggggaccctgagccaaggaaagcaggcagcctctaagaagatgaaaaaggtaaggaagtagattttttccctagagctcccagaaagtattgaagccccaccagcaccttggtttagcttagtgagacctatatcagacttctgacttgcagacctacgagatacatttgtgttattttatgcctttgaatttgcgataatttgttacaggagcatactagtttgctagggctgccatgacaaagtagcacaaactaggtggcttgaacagcagaaatgaattgtctcaagttctggaggccagaagtccaagatcaagttatctccagggttggttccttttgaaggctgtgagggagaatctgttccatgtctttctcctagcttctggtggtttactggcaatctttggcttgcagatgcatcacgctgatctcattcttcatcttcgcatggcattctccctgtatgttcacatagtctttccctgtacctgtctttgtttccaaattttctaatcttctaaggatccaggtcatattggattggggtccaccctgattatccccgtagagaccttatttcctaataagattacattctgaggtactgaggattaggactcaacatatttttttggggcgatacaattcagcccatgtaggtagaaacagaaaactaaagctacgtaaaattgaattgtttttcaaaatggatgctgaatataaattgatacatttatatttttgctatcagtgagtaagaatgcccctggatccacattcttatcaaccagtgcttcctatttactgacttttaagtttggctagtctagtgggtatgaaatggcatttctttgtgattgtaatctgcatttttctaatttctagatttatatgtatgttgtgatgtagagattcaatctcattttttatccaaatggatatccagtcatgccaacacactatattgaaaagtttatttattctccattcatcagtgctgcctctgtcctatatcaaatttcaatatatgtatgactgtatctgggctctattatgtttgatttgttagtttatgcatcttgtgttaataccacactatcttagttataatagctttctaataagacttaatatcctgtattgatagtgtccattgatgtgcaaaagttttcaattttgatgaagtttatctactttttcttttgttgcctatgattttggtgtcatatcaaataaatcactgcaaattcaatgtaatgaagctctcattctgtgttttctttgaggagttttataaaagttttagttctaatatttaggtctttgattcattttgagttaatttttgtatacaaaattttgtataattacagtgtaaggtaatggtccaactttattcttttgcctgtggatgttacatttttctaagaccatttgttgaaaaaaactgttaataacctttcaacaaagtgttggcttctttgttgaaaattatttgacagtacatgtgaggatttattgctaggctctctgttctatgtcataggtctatacgtctgtgtttctgtcagtaccacactgttttgattattgtatcttttagtaagttttgaaatcatgaagtttgagacctcaaactttgttctttttcaagattattttggctatttgagtgtcctttgagattccaatatgaattttaggatgaatttttctgtttctgcaaaaaatgtcattggggtttattttttattgtggtaaaaaccataaaatttactctgttctttatttttaagtgtacagttcagtggtgttaagtatattcacattgttgtgaaacagatctccctatcttttccatcttgcagaactgacactctatactcattaaataacaactacccttccgctgtcccctgataatcaccgtttgactttatgtttcaatgaatttgaggactttagatacctcatataagtggaatcatacagtatttttttgtgacttgcttatttcacttagtataatcatctttgggattttgatagagattgccttgaatctgtagattgcttttagtagcactggcatcttaacaataataggttttctaatccatgaaaatgggatatcttttgatttatttgtatattaatttatttcagcaatatttcatagttttcagtgtatgagtctttcacctccatggttaagtttattcctgagcattttattcttttcaatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctgaaaaaaatgattgggggacaggtgattaaaaaaactgtcgctggccgagtgtggtggttcatgcttgtaatctcagcactttgggaggccgaggtgggtggatggcttgaatccagaagttcgagaccagcctgggcaacatggcaaaaccctgtctctacaagatacaaaatattagctaggcatggtggcgaatgcctatagtcgcagctacctgggaggctaatgtgggagcatcacctgagctggggaggtcgaggctgcagtgagctctgattgtaccactgcactgctgcctgagtgacagagtgagactctgtctcaagaaaaatcccccaaaaccccaaaacacacacacacaaagttatataggtcagaagagttggagaataagaagtaaagtataacttggacttaattgaagttcgaaaaggggataataaaatggagaggaagaaatattagaaaaaaatgtctgtaaaatagcattttaaagaactgatgaaaaatgccaagtttttgtccagaaagctcactgaatctcaagcagaataaattaaaagaaacccatacattattgcaaaattacagaaccttaaataaaaagataactactaaaagaactcagaaaagagaaatggccttcaaaagaatgaatggcagttttactgaaaggtgacttattagtagccacagtggaatccataaagcagtggaatatcatccgacaggtgctgagagaaaataagtgtcaaactagaaatcagtgccccgcaaaactatctccctaggaaaagtgcaagctaaaacaattttagaaaaggaaaaattgagggagtttttaccactgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaataattaatatcagagaaaaaaggaggtcaaaaaaggaaacctaggcgaacaggacaaatacttaaagcatgtaaaaagatgatagaaataaatctagatactaccacgaatcacaataaatatagaagcaaaaactttgttaaaagaatataaagattgtccacttggattttctgactgtatactctttgcaaacataagaatttatcaaggttggaaataaaagaatggaaaaaggacacaagacactataataaaactggtaatattaatatcagaaaaactgggaaaacactttgctagagaaaaagatgatcattatgtaattataaaagactgaattcaccaagaagataaaatttaaaattgtagatacctaataacataaatgtctatgtctatatatatacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaatggatatctgttattatatttatacttattgtcatttcttataatgtttccatgttaacctttagtgaagaaaagaactgtgggtggagatggatcccaatttcctactgtctttggtattttccttaatagacagttattgcacagtggtgaagctagactgcttgagtttaaatgtcatctctaccacttacagaatgttggacaagttgtttaacttctctgtaccccagtttctctgtgtataaattaggggtaatcacagtacctatcttattgatgtgaaatagatgtgatatgaaatgttgtgaggattaataacctgtaagttcttggaacagtgtctggcacctggcaagttttcaacagattagttgttatggctgttactattaatagttgaaattctcatccttgaattatttaatagtttatgccaagtttctctaaatcaatggtaaaacgaattgaaatttagatctatgagacaatccgtttttattgtctcgatacttctcttgggactggtattaagcaaaaaagcaaatcctttccataagggattatataggggaaattctttcaacagtggtcagtatttaggacaacaaagaaaagatacaaggagtaatttaaaaagtgattaaaaggggggtaatttggatttattttcttttaaagtttcagagttaaagattaagaacctttggtcttccagaagaaaaatgtgtcagctgctacagtcataatttactgtcccataagctttttgttccagtttgtcactttggagttgggagtacactgggaagtcaaacaaatgtctttacccataattcttccttcacagttcactgtctgttaagcatgttgataactatgcagcacctccccaggaatggtaagagggagataagagatacggaaacagaaagaagagaaactgtatgtaaaaaagtgactcttccaaccctctttttcactccagtcagtattagtcactttactttactgcttcaatgtaacactttgttccacttttcagaaaaagtctcctgaagagcttctaccagttagatagtaatcgttaaaagcagacaaaaataaatatggataggaatttttaccaatatatgggaaaatatttttctttacgggaaaatacttacatacacattactaaataccagtgtttatcattatgtaagtcattttttgtttgtttttgttgtaaaaatatgcaccatctacaaataactttaatacctgaaaactcatttcttcagcagcattactgggcattctgctaggagctataaaggctatgaaaaagaatcacataatgtcattattcttaggagtttaatgtaagataaaaagtgaagattatattttaaataataaaacaggcagtgcaattaatattgtagtgtttgagaggtctcaaaaaataacacccaaattccctgcccaaattttgagaagagagtgacagatgagatatcagaatactacctgtattcctgataaagctgttattcgaaggcatggcttgtatcagtagatagttttgctttctaataccaaaccccagagttaaacagacttccctggtcattagcagaataggaccaggaacattttccctgtttgcctggagagcctatccatggagaagcattggagaacttctgcttccatctagtgggtaggcttccaagagcaaaaaaaggggtagaattatgcttacatgattctttagtctaaacttaccagtcaggtaagtcactatcctccttctaggggataaataagtgaaagggtagagagagtccaaaaatatttagcaacagttcttcctcatagaagccataggattgagaaaaaggcattgcctctctcaacacgataatagaaaaagctatttgaaattctgacatcttttagacaacatatattttaatttttgcttgtcgcctttcttttttttttgagatggagtcctgctcttgtcgcccaggctgaagtgcaatggcactatctcggctcactgcaacctccgtctcctgggttcaaggattctcctgcctcaccctcccaagtagctgggattacaggcatgcgccaacactcccagctaatttttgtatttttagtagagacgggggttttgccatgttggccaggctggtcttgaactcttgacctcgtgatccgcccgcctcggcctcccaaagtgctgagattacaggcatgagccaccgcgccagatgtcacctttcttgtaactatagtgtctatatagttgcatggaatgtacataatttaaaaactgagcctagattctgcctttgttcatttgtttctttcttgacaaaatcaagtcacttatttctgtgcatttattgttgcacttaatattctctatcatatttgggttgataggcctttcctgtctctacattttatgtcctttaaattcagggacagtatcttatttatttatgtgaccctggtgcttggcatatatcaaatagtttattgagttggattattggattaaatactgtttttttaaatcacttcgcaggacatttttttcctagttgatacataatactcataatttcatcactgaaagtaacttgaagaacaggatgcctaaggaataagttcttgatgtcacaaaacccagcaaaaatcttcttcagcaggggaagcttacttaggtgaatgcctcagtttataggtgaagcttggaagaatgttgcaagttgggagaatggaaactaatgcaggacattgtgtgcaggagttgcctctaaaataaaggaggagcatggaatgataatttgaggtgaggtcatagtgaggcagtagggttataaacagttttgacattactttttcagatatggcttgcagagttaaaaattcctagatgtttcaatggttctcagttaacaagtgttgatagaacattttcagtgcttagactgcacttttgatttctagggagaacttcatttttaacataaatttactaattttagtagttcaccaaggaagaagatggtagtaaaatactggtcataattatttagcaaactctggaaatgtgattttttaaaaaaacttttctttaagttcaggggtacatgtgcaggtttgtaaaggtaaacttgtgtcatgggagtttgttgtacagattatttcaccacccaggtattaagcctagtacccattagttatttttcctcatcctgtccctcctcccactccggtaggccccagtgtgtgctgttcctccctacgtggtcatgtgttctcatcaagtacatttttgtcaggtaactgaagtttatctttttacaagtaatatctttttaattcaaacacatttttgctgtgactatttctattatgtttacccctatttctgcttaccctgaatagatcttgatgaaaataatatatttctctgaaaagtaaggattgtcattttaaaaattagtaaacatgtatttgacaaaattattagcaggcacagcagaagcagttcatacaatctgtttggtaaactgagtgatctcccagttctgtgttcccccaaatagttcacccacacattccataaaaggttctctttaggcagatgcaacaataccctgaaggcataattgttagctttatagtcagcattaggcaattaaaatcctccgaaattaattccagacttggctgtaaccctaagagccattctggaagacagaggatgtagagtttacgagatcttatgccctgtttataagggaggggaatatccccaaaatatttaggagagttcacacatactgaatgccactaatttcaacgacaagagcttatttctaatattccttatattattgcttctaatattctttttttttttttttgaggtggggtctcgccctgttgcccaggctggagtgcaatggcatgatctcggctcactgcaacctctgcctcccaggctcaagcgatcctcccacttcagcctctggagtagctggggctacaggcacgtgccaccattcctggctattttttttttgtattttgtagagatgaggttttgctgtgttgcccacgctggtcttgaactcctgagctctagtcatctgcccaccttggcctcccagagtgctgggattgcaggcatgagccactattcctggccccttctaatattctaatactagaatattccttatattattctttctaatatttcttatatttctaatatgccttacattagtctttagggctaataggaatagcttctgaagtgcttataatagctgcttcgggagtgtggcctttctgattaaatgctagctgatcacccttagaatataaattcttgttaaataacatatttacatttaaatagcaagaaaggagaatgtaagcatcctgaagataagaatttttgcctgttttgacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactataagtagttcaaccattgtagaagacagtgtgacgattcctcagggatctagaactagaaataccatttgacccagccatcccattactgggtatgtacccaaaggattataaatcatgctgctataaagacacatgcacacatatgtttattgtggcagtattcacaatagcaaagacttggaaccaagccaaatgtccaacaatgatagactggattaagaaaatgtggcggttaagaggaggatagtcgagatggccgaataggaacagctccggtctacagcttccagcgtgagcgacgcaaaagacggttgatttctgcatttccatctgaggtactgggttcatctcactagggagtgccagacagtgggcgtaggacagtgggtgcagcgcaccgtgcacgagccgaagcagggtgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacaagattatatcccgcacctggctcggagggtcctagcccacggagtctcactgattgctagcacagcagtctgagatcaaactgcaaggcggcagttaggctggggaaggggcgcctgccatttccgaggcttgcttaggtaaacaaagcagcaggtaagctcgaactgggtggaacccaccacggttcaaggaggcctgcctgcttctgtaggctccacctctgggggcagggcacagacaaacaaaaagacgcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagtaggggcagactgacacttcacacggccgggtactcctctgagacaaaacttccagaggaacgatcagacagcaacattcacggttcacaaaaatccgctgttctgcagccaccgctgctgttacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccagaagtagataaaaccacaaagatggggaaaaaacagagcagaaaaactggaaactctaaaaagcagaacgcctctcctcctccaaaggaactcagctcctcactagcaatggaacaaagctggacggagaatgactttgacgagttgagagaagaaggcttcagacaatgaaactactctgagctacaggaagaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagccttaggagctgatgcgatcaactggaagaaagggtatcagtgatggaagatgaaatgaatgaactgaagcgagaagggaagtttagagaaaagagaataacaagaaacgaacaaagcctccaagaaatatgggactatgtgaaaagaccaaatctgcgtctgattggtgtacctgaaagtgacggggagaatggaaccaagttggaaaacactctgcaggatattatctaggagaacttccccaatctagcaaggtaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccatccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagcccctgcaaaatcatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacactcctcacttcaaaaaacctgtctcacgtgcagagacacacataggctcaaaataaaaggaaggaggaagatctaccaagccaatggaaaacaaaaaaaggcaggggttgcaatcctagtctctgataaaacagactttaaaccaacaaagatcaaaagagacaaagaaggccattacataagggtaaagggatcaattcaacaagaagagctaactatcctaaatatatatgcacccaatacaggagcacccagattcagaaagcaagtcctgagtaacctacaaagagacttagactcccacacaataataatgggagactttaacaccccactgtcaacattagatcaacaagacagaaagttaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaacaagcagaaattataacaagctgtctctcagaccacagtgcaatcaaactagagctcaggattaagaatctcactcaaaaccgctcaactatatggaaactgaacaacctgctcctgaacgactactgggtaaataatgaaatgaaggcagaaataaagatgttctttgaaaccaacgagaacaaagacacaacatatcagaatctctgggacacattcaaagcagtgtgtagagggaaatttatagcagtaaatgcccacaagagaaagtaggaaagatccaaaattgacaccctaatatcacaattaaaagaactagaaaagcaagagcaaacacattcaaaagctagcagaaggcaagaaataactaaaatcagagcagaactgaaggaaatagagtcacaaaaaacacttcaaaaaatcaatgaatccaggagctggttttttgaaaggatcaagaaaattgatagaccgctaacaagactaataaagaagaaaagagagaagaatcaaatagacacaataaaaaatgataaaggggatatcaccaccaatcccacagaaatacaaactaccgtcagaggatactacaaacagctctaagcaaataaactagaaaatctagaagaaagggataaattcctcgacacatacaccctcccaagactaaaccaggaagaagttgactctctgaatagaccaataacaggctctgaaattgtggcaataatcaatagcttaccaaccaaaaagagtccaggaccagatggattcacagccgaattataccagaggtacaaggaggagctggtaccattcctcctgaaactattccaatcaatagaaaaagagggaatcctccctaactcattttatgagaccagcatcatcctgataccaaagccgggcagagacacaacaaaaaaagagaattttagaccaatatccttgatgaacattgatgcaaaaatcctcaataaaatactggcaatccgaatccagcagcacatcaaaaagcttatccaacatgatcaagtgggcttcatccctgggatgcaaggctggttcaatatccgcaaatcaataaatgtaatccagcatataaacagaaccaaagacaaaaaccacatgattatctcaatagatgcagaaaagtcctttgacaaaattcaacaacccttcatgctaaaagctctcaataaattaagtattgatgggacatatctcaaaataataagagctatctatgacagacccacagccaatatcatactgaatgggcaaaaactggaagcattccctttgaaaactggcacaagacagggatgctgtctctcaccactcctattccacatactgttggaagttctagccagggcaattaggcaggagaaggaaataaagggtattcaattaggaaaagaggaagtcaaattgtccctgtttgcagatgacatgattgtatacctagaaaaccccattgtctcagcccaaaatctccttaagctgataagcaacttcagcaaagtctcaggatacaaagtcaatgtacaaaaatcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaaaccactgctcaatgaaataaaagaggatacaaataaatggaagaacattccatgctcatgggtaggaagaatcaatatcgtgaaaatggccatactgcccaaggtaatttatagattcaatgccatccccatcaagctaccaatgactttcttcacagaattggaaaaagctactttaaagttcatatggaatgaaaaaagagcccgcatcgccaagtcaatccaacaccaaaagaacaaagctggaggcatcacactacctgacttcaaactatactacaaggctacactaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccgttcaggacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacacacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatgacaatcattaaaaagtcaggaaaccacaggtgctggagaggatgtggagaaataggaacacttttacactgttggtgggactgtaaactagttcgaccattgtggaagacagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatatggcacatatacaccatggaatactatgcagccgtaaaaaatgaggagttcatgtcctttgtagggacatggatgaaattggaaatcatcattcccagtaaactatcgcaaggacaaaaaaccaaacaccacatattctcactcataggtgggaattgaacaatgagaacacatggacacaggaaggggaacatcacactctggggactgttgtggggtggggggagtggggagggatagcattaggagatacacctaatgctaaatgacgagttaatgagtgcagcacaccagcatggcacatgtatacacatgtaactaacctgcacattgtgcacatgtaccctaaaacttaaagtataataataataataaaattaaattaaattaaaaaaaagaaaatgtggcacacatacaccatggaatactatgcagccataaaaaaggatgagttcatggccttcgtagggacatggatgaagctggaaaccatcattctcagcaaactgtcgcaaggacaaaaaaccaaacactgcatgttctcactgataggtgggaattgaacaatgagaacacatggacacaggaaggggaacatgacacaacggggactgttgtggggttgggggagggtggagggatagcattaggagatatacctaatgctaaatgacaagttaatgggtgcagcacagcaacatggcacatatatacatatgtaacaaacttgcacgttgtgcacatgtaccctaaaacttaaagtataataataataataataataataataaaagaatttttgtctgttttgttcactgccatgtccaaaataatgcctggtaagagctcaaatagctattgaatgggtaaatatcacactgactttgctgaagtatttaaataattttcagacattataaaaagaaatacattttggccaaaagcttaattaatgcaagagtaaaaaaaaaaaaggtttgaagcatacaatcctatttcagggggctcaagagtttaaaaggaagaaagggggagacatccaggtaagaggacacgtatgctgtctttccaatattggacattatctactttttctgagacagtatcgacgctttgagcatgacacatctttttgtaacagagtcctacttaagctcaatatttaattggtacttagagccaagaaatacatgtgggcctacatttttttgcatgtattttgtgttatagcctctatacaatctaaggacacttggttctttctctcaaaatcctttcctcacttttgagtaatttacttttgaatttataaatacctcaccttattattcatcatattatttgcattatgttaaaccctggtcaacccttaaaatgttaaaggaaagacattactatattttttaatgaatacactaaacttttaagtacaaatatatttgtcatcagcctctgcaaagccatcagatgtttgaaaaaaaattttaagcatgaagcaaagagtctagttttaagaacttagctgtgaatggatgatatcctacccatttaatagagttctccaaatgaacagaaagtatacaatgaaaggaaggtcccttagacatttgaagtttttctgcagcacaatcctgtctgtctgctttattcaagaatttgtagtcattttcagaattcattccagaaaccagcttattcgtttagatatcagcacactggtcttggcaaaagataacacaaaagtaaacactactatgtcaaaaaggatgaaaagccagcgatccaaccagtagaattgttttggaagctgtttgtctcggactgagatcacacattaagccttggctgttgccttccattcttgcacaagcctccctgctcctggggaccctctgtaagagtgagcgtcctaatgaaaatagatggcacactcaaatggctaaagtagggagagtttatgaaggaatgatttataaaagagtgggaagtgttaagagaacatggtatgagtatctgatgagcaacagcagatagccgttatcacctttagacatacaagggcagaatagggagctgttaagactcagagagtagctgtatagagattcatttgaaagaagccgtggctctggtagtagaggagcatcactaaccagaggtgattttacatgagagcaggggtggaggtgggtgggagagtgggggagaataactaccccaggctcacttcctgtctttctgtcttctgctcttgtattccattggttgactccaccccaaagacagagggcaaggggggctttggatataaacaagagtctcctggggcactgaacagggtggaggagaatgaagaatggatctggaggggcaaatgaaatattcgtaacactacctttttttaaattatacttttaagttctagggtacaagtgcacaacgtgcaggtttgttacatatgtatacatgtgccatgttgggtgtgctgcacgcattaactcgtcatttacattaagtattcctcatgctatccctcccccctcccctcaccccacgacaggccccattgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagtattgaaataaagagtatgttgagaaaatggaaaatatttcagatagtttggagtgtgtgcttaagaagaataggcataaaaatgaaagcataggttagtatttgtagacaaatgttaatctttatattgcatatcctcttatttattactaagtcttgtattataaatgtttttataaatacctgagaatcaatagtgccttcatcattaggtgggagatagttggtcgagttttgtgccttagcatagttatctgggtgatttacacatagcggcttagtgcaaatagtacaaagatcagaagtcatttagagagtggggctttcagttaagaatataggctctggatttgcaccatctgtgtttaatttctgactccagcactttccagcttgatgaccttaggcaagttatctaataccggctcagttttctcattttcaaaataggtacagtcataatagttttattttagagtagttgtgaggattgagtaattcacatatttagcccagagcctagcagatactgttaataaatgttacctattttttgttttttagtttaggagggtattataggtatctttgaatatttgaaaggctgccccatgaaatagggattaaacttgtcttcatgagaacctccagtatcagaatcaggagtaatgtgtataagtaacaggcaaacagatttgggattaatacgagaaaatcttttaatagttatagagttgcttgaattagaataggttagctcatgagataatgatttacataccaagggaagttttcaggaaaacatcaaggggatgttttaaagtattaatgtctcaaaatgagaaaattagataaaagctttaggatatcttccaaccataatagtctattactttatcctaaaaaatttgtgaaaatcaaattttacgtaagaggaaatgtgtttgatttccttttccacatctctgtctgttcctgttgacaatttctgttcctaactaccttccaacaatccagcttacatgtcatctatctttgtttaatgatacgtataatttttttttttttcaagagacagagtctcaccatgttccccagactgggcgcaaactcctgggtaggtaatactcttgcatcagtctcctgagcagttggtactacaagtgcacaccaccatgcccagcatatttaacaatatttattgagcacatacaaatgtgccaggtattgcgctggatactgtgattagtacagtgaacaagacacatcagtctcctgccctaatggagctttaagaaattttagcagagggaaatagaaagtaaaaacacagtgaaataaatttcaggtagttttaagtactgtgatgcatgaagaaaataaaacagaataatagtataaagggatactagggctttggatggtggaggtgaagatggtgctttaggtatggtaggaagggaaagcctctctgaagaggtgacattttaaccagcatataaatgttgagaaggagctggttgtgctgagggaagcacactctaggcagaagaaccagcaaaggccctgtggtgggaaagatcttgacatgcttgttagaaagcaaactgggtggctagagagtggtgggagtggtaagaacagtgtggatcacataaggccttatacaccttgttaacatttacatttcactccaattgcattctaatggcaagtcatgagacaattttatggtataatttatgtttaaaaaagattattcttgcttgtttatgggctattgacggaatagctagagtggaagcaggaagataggaggctgttggagttatccaagtgagacataatagtgacttggactatctcagatgactttctcccccatttatccctggatagaatgtcctttaaaaaatattttataggccaggcatggtggctcatccctgtaatcctagctctttgggaggccgagatgggaggattgcatgaggccaggagtttgagaccagtttgggcaacatagcaagactctgtttttacaaataattaaaaaattagccaggcatggtagtgtgtgcctgtgttcctagctacttagggggctgaggtgggaggctaggaatttgaggctgcagtgagctgtgattgtggtactgtactccagcctgggtgacagagtgagaccttgtcttgaaaaaaaaaaaatatatatatatatatacatatatatatgtatatatatattttatagtgtttaccagatactagtgttaaagtatctttatattatattttaattaggtatacaattggctttctcattagattctgagtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagtccacagagtccagataaataattttattttaaacaagtgaggtgaaagttgcatgtatcatcttgctcatattccactggtacttagtcatatggtcttactcagctactagagagatggagaaatgtagtttttagctggggagtcatagcaaaaactttactttttttttttttttgaaatttaaagaaaaaatctattgaagatctgaaaaacaattcctaaaagatagacttttccagaaaacactagctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaagaaaaaggatctattaccccttttattttctttgtttaaaacaaaacagaaaaaaacatcagttgttacacactaacatcttcaaagcacatcgtttgtacaagagatagactaagaacaaaaatgtgtttacagagatccaaacataagtgagtgagagcgcctctcacatggctctcaggacggttctcaggaggagccacttcataatctctggcactaaacaaagttgtagaattctttgccaggtacttcaggaaatcatgaagataattcagtaattaagcaaggctcttctcatccagaggtgtataggccaacattgctccaattcgtacaagtaatctcaggagatgtggcactccatacacctgggacatgggtgccttggggtgatctgcaagaatttcggcatactgtggtctctcaaatttgtagagtagttgggtgcccaacattacgttgaagtattcttttatccctgccacaacttcattaaccgcatactccttattatctgtgtttccaccagatttcttgtaatttgcgtaatcctcaagaatggaatccacatttcttcttggcaggaagttaaaagagctgttttcgtctggtaattaagtcccagtcatcaacaagccacagttttagctcttcaggaagctttactttaacttcaactctgttcatgaatgtttcctcattttcaacagtaggatctacccgggtccttttcttccgaggaggccaaggagtctcactggtactgccaccatctccatttccaggggttttctgtttgttcttttttgttttcacttcaacatttttctgttggagaccagatgtcttctttcctggggcagcccctatcgtcttcccctctgcatactgctcctgattggctttttgaagttcttattctttctgcaaattagtgtccttgtatttgagtactctgctctctggaacccactcatcccaatttttattccaaccactgtaatgtataaagtatttcacttgtttgtccttaatggcaacctttacacactttgtttcatgaagaagaggcccatgaaagcacagcactcactcaacctcctggaatttaggctttgggtcctgttttgaagccatttataagtgatttgctgtctcctccttctcctaccacccccaactaaaactttactaactttgattttcagctaacaatcttctaaagttgctgttatttgaactacttaaagtgaatatgagggtaacaactaattaatttctgcttcttaccctcataggaaaaatattgaacttctatgtagcacttacacttagggagagacatcttgatcctgattgcaactgggatggaaaactgattttattactattctaagaaaagtttttatttgtatttttattaaaaatgaagttatgttcaaatgaaagagagtatgtatgagtcttgaaaattgttactttaggtaaggcaggactactaatttttttattatttttataaagaaacaactcttgctcaccaaagggcttgtagaaatggtgggctggttgccctcatggcaggtataaaggatacggatgtataatatttctattaaggcagtttgggataagggattacttattgcttttaatgtatatcttccttgttatcacatattaggttgatataattcttcatcaggtagaactgaagttctcagagttggagttgaggatgaaaagctgctttagaaccttttaggccttaagtcagtgtttctgttttcaggactgtctcctaaagagaggtaacttttttttctgttggatggtaaattatcacctatttctctatttcttaagagcagacataatctttggggtcgttcctttataatcttgattcagtattttttctttcttatcaatattgttattcattttattttttgcttatttaaaaaaaattcagataatttacatataataaaatgcatgggcctaaatgttgagttgaagttttgatggttatatacacttatgtaatcatgaaccaaaacaagatacagaatctttccttgaacttctttccggtctgttccatccagctcctcagagacagccacttactgatttctattgccatgtatttgttttaactgttttttaacctctttaaataaaattatacagtatgcattcttttgtgttgagcatctttcacttcatatactgtcctgtaatgcattcatattgttttgtatatcagtcgtgaatatattcaatgaatatgttccctgaatgaatatattttatgaatacatcacaatttatttattattctgtcacaatttgtttatacattcttatgttgatgaatatttaggtttccagtttttgccttatgaattaggctgctctgagcattcttgtgcaagtcttttttgtggagacatgtattcatttctgttgggtaaatacctaagagtgaaattaagtcagagtagatgtgtatttaacattaaaagaaactgacatacactttttcaaagtggttgtaccatttacactcctaccagcaatatatgagagttccagttgccctacatcctcactaacatttgatgttgccattcttttattttagccatatagtacctgtgatgttgaatgcctttttatgttcttattgaccatttatgtatcttcttttgtgaaatgttcaagtcttttgctaattttaaaattggattgttcattttcaaaaaattactggtttgtagttgttttagacagtcatgcgttgcttaacagtgaggatatgttctgagaaatgtgttaggtgatttcgtcattgtgcaaacatcacagagtacttacacaaacctagatgttacagcctactccacacctaggctatatgttatagcctattgcttctaagatacaaacctgtacagcatgttactgtactgaatgctgtaggcagttgtaacacaatgctaagtatttgtatatctaagcatatttaaacatagaaaaagtacggtaaaaatatgtacacctgtatagggcacttaccatgaatggagcttgcaggactggaaattgcatttggtaagtcagtgagtgagaggtgagtgaatggaaggtctaggacattactgtacactattatggactttataaacactgaacacttaggctttttagttttccaattactttataaaaaagtaaccgcgtcacaatgtcatgacagctgcaactgaaagttcattatgtggcatgtcactatattatggatgtgagtcctttgccatatgtatgtgttatgaatattttctctcaatctgttgcttacctcttcattttccaaatgtctttggataagcagacattttaattttgtttaagtctaatgcactaatttttttcctttacatttagtgctttttttataccttaagaaatttttgcttaagcatctctaaggtactctgttttcttctagaagttttatggtgtatgatctaacttgaagtaattttttgggtatgaggtaaggtagggggtcaaagtttgctttttccatgtagataaccagttgttccagcactgttttgttgaaaagacttgacacccttgtctaaaataaattggtagtatatttgttggcttacatataggaagctagccttagtttttaattttttttctgatttaaattctaaaaaaaatgaaaaccagggatagaacctataatgggtaagatggcacttatcttgttgtattttagagttttctggtggtgtcattttcagaatacattttgtgttcctcagaataaaggaaatgaagcttatttcttttattctcaagccaaatcactctctgaggattgaggaagtaatccagggtttgatatggggctcatggcataaggttaggtagcctgttatctttaactttctagattacttcataaaaataacttgcgtatatgtaatgatatctttctatgttttagatgttgttcaaagcactgaattgtaaacatattctcaatatttccctcgaatcttaagtatttaccttttattttttttaatttaaaataaaaaattaacagagtaaaatagatgttttttggtgtatggttctatgaattttaccatgagtatagattttgtatatccactacaacattcaggacatagagttgtcccattacttccagaagttcccttgtgctttctatccctttgtagttatatcttccttctatccctaatccctggtaactactagtctcttttccttcactgtagttttatcttcttgatgtcataagtgaaatcacacagcatgtaaccttttgagactggctacttttatttagcataatgcctttgagattcatccgagttgttgcatgaaccagtttatattttattgttaagtagtagtccattgattggatgtacctgtttatccattcattcatcctttttatttggggggacagagttttggtctgttgcccaggcttgagtgagtgcggtgacacgatctcggctcactgcaacctccgcctcccaggttcaagtgattctcatgccacagcctccggagtagctgggattacaggcatgcaccaccacgcctggctgatttttgtatttttagtagagatggggctttgccatgttggctaggctggttttgaactggcctcaagttattcacttgtcttagcctcccggactgctgggattataggcatgagccactgcacctggcctatccattcattctttgaagaatatttaggttttttttttctagttgtgttgattaggaatagaactgctgtaaacattcacgtacaagtttttgtgtgaacattagtttttattcctctagtgtaatacctgagagtgggattgctgggtcatttgttaagtgtatgtttaactttataagaaattgccactgttttccagagtgtttatgccattttgcagttttactggcagtgtatgaaaattctagtagttccacatcctgaccagcacttggtattgttagtatttttaatttttgtcattctaggtgtgtagtggtattgcatcatgatttaaatttgcatttcgttaatgggtaatgattttgagcatctgttttttatgggtttatttacattatatatcatctttggttaagtggatataagtcttttgttggatttgtgatttgcaaatattttcttccagtttgtagcttgtttcttcattctatgaacaatgtctttcagagaaccgaagattttaattgtaatgaagttcagtttttcaattttttgttttataagttcttttgatgtaatatttaagaactttttaaccacaggacatgtatattttttcttatgttttcttataaatcttataaaaatttagtagctttatgttttaccttaagacctgtgatgcattttgagttgatttttgtataaagtgttaagtttaggtttattttctcctacatacagaatttccaattctaacatcatttgttgtgtactctcctttgtttatcgaatggctttggcacctttgtcaagaattaatttgctatatttatgcagatttatttccgggttattgattctgtcacattgatcaatgtgtcattccctctgccaataccacactgtcttgattactagaaaattgtgtagtgtgaatcttcttatcttttttttttcaatattgtttgacctttgcagaaacattttagaatcagcttgtttatatctatgaaaaatttggctgggatttccattataatcacattaaattagtagaatcaatttgggtagaattgacattttttaggctcttgagcccctatgtgtgggcccactcccactctgtggagtgtactttcattttcaataaatctccacctttgttgcttcattcttttcttgctttgtttgtgcattttgtccaattctttgttcaagacaccaagaacctagacgccctccaccggtaacatattttggcaagccagccaggatgtaaaataagtttgggatttatttttttccttttcctttctgctccacgcagtggaatctcttcttcactcgggacccttggtgggcagcgcctaaacacagaggcaactgcagatttctggctgggatcactctgaaggactctcttctgtcttttctgcttgtggttcctgatccctacatgtggagcagctcagggcgaactcacatgtgtttcaggcaacttaaatcttcttttcttacactaaatttttcccttactctactcgactggctaaggacaaaagaaacccacctagcctccagttcctatcactacagttcacggaatggagcaaagtccactttgctccatcactctagtggaacaggaagcatgctgttccactagagtgggaccaaatgctcctcctttgctccatcactgtagtggaccaggaagcatgggaaaagatggccttatcaaattttaaggattctgaaagtcagggattatacctaggaaccaaagggaagctcatagtagtaggccattgcctctggagggaaaacatgcaaagcggcactggtgcccacgtaacgtcagagacgtctgatactcttaagactggaccccaaagagggatgccccaggggatcctttggacctcaacctctctgaagggaacacccttggcagaggtcctaaggcctagtactaagccctccttagaattttatctcacagttgcaatactgtttggccccagtattgtttggaatcaagtgtgttgttgaatgggaaagtgagatggagttgcatgtatccaggctttgatgctgctgttccaagcagggtcaggcctggttatatgtgatgttctcctttggtgctgtttggccccagtgttctttggagtctggggaggtttgacctttacaaattaaactgccatggaaactgctttacctgaaattttggttcactgccttcattggattaactactggggcaaacaaaagtagaaccggcaagtttgtattgctgtctcatggctagagttccaaggtaaaagctattgaatcttcatttgtatgtgtatatacatgtctagatgtgtttatttgtatgtacacttattgttatacattctgtctacaaaactgacatacacgtaaaagagtactcataaataagtctaagtacttttcaagttcatgtgacttaagtataactttactaaacaagctggttttaaaatgattggtaaaataaaaatagaaatgacttcaaaaaaaaaaaaggaatggacattttttactgttgagtcttccaatccatggacatgatatatctctttatttacttaggtcttctttgattttattcatcagtgtttcgtaatttttagcatataaaccctgttgactttttgtttgatttacatgtaagtacagatcctcctcaacttatgatgatggggttatgtatccagataaacccatcgtaagttgaaaatattgtaagccaaaaacatatttttggcttacagtattctcaccagtcaaaaccagactttcaatttatggtattttcaccagtgaaaagcacacttttgacttaatattttcaaaccagtgaaaagcacatttttgacttaatatttttatcagttgaaagcacactttcaaattgtgatattttcaacttatagtgcatttatctagacataacctcattgtaagtcgaggagcatactgaatgtatattgcttttgtaccactgtgatacggtttggctgtgttcccacccaaatctcatcttgaatggtggctcccacaattcccatgtgtcattacttccagtgggaagtaattgaattgtgggggagggtctttcctgtgctgttctcgtgatagtgaataagtctcatgagatctgatggttttgtaagggagagtttccctgtacaaattctctcttgccatgagtgtgaggacttccctgccatgtggaactgtgagtcaattaaacctctttcctttataaattacccagtctcaggtatgtctttattagcagcgtgagaacagactaatatacattgtaaagctgaaaaattgtaagttgtaccatcataggttgaggactgtctgtatttatttcttagagctgttgtaaatggtatttaacaagaattggtttccagttgctctttgctagtatatagaaatacaattgagttttgtgtgttggctttgtattctgtgatgttgctgaattcacttattagttctagaagcatttttcatagagttcttgagatttttctatgtacagttgacccttgaataatgcagcaaggtggaagttaggggtgctgacccctgaagcagttgaaaatctacaaataacttttgactcccccaaacctaactactgatagcctgctgttgactggaagccttaccatcaacataaacagtcaattagcacatatttttatgttatatatgttatatactatattcttacaataaagtaagctagagaaaagaaaatgttattaagagaatcacaaggaagagaaaatatgtttactgtttaattcatggaagtggattatcataaaggtcttcatcctcactgtcttcacattgagtaggttggggaggcggaggaagaggaacagttagtctgtctcaggggtggcagaggcagaggaaaatccacatataagtggacctgtgcagttcaaacctgtgttcaagggtcgactgtaaatgataacgttgtctgtcaataggacagtttgatttctttctttctaatctgtatactttttatttgttattttcctgctttattgtactggctaggacttccagtaccatgatgaataagagagatgtgatattatattttttccttggttccaatctaggaaaccattaaatatgatgttggctgtagttttgtttaaatgccctttattatgttggggaggttcctttcagttcttagtttgctgagagtttttatcatgaatgaatgttgaatgctgtcaaatgcctttttttgcatcaatatgatcatgtgggtttgtttttaaactgttaatatgatggattatattggtcaatttaaaaaatattgaacagctttgcattcctagtataaatcccacttgattgtgatatattcttatacattgctggatttgatttgttgatattttattaaggatttttgttgttgctatgttcatgagggacataggcctgtagttttttgttgttttttttttaataccttttttggtattggggtaatggtgactctcaaaacgaattgggaagttttccctcctctattttcagaaatgagtgtatagacctggttttatttcttcttttttaaatatttttcttttattgatacatagtattgattttttttttttttgagacggagtttggctcttgttgtccaggctggagtgcaatggcatgatctcagctcaccacaacctccgcctcccaggttcaagtgattctcctgcctcagcctcccaagtagctgggattacaggcatgcgccacaacgcctggctaatttttttctgtttttagtagagacagggtttctccatgttgatcaggctggtcttgaactcctgacctcaggtgatccgcctgccttggcctcccagagtgctgggattacaggcgtgagccaccgtgcctggcctgatttttttcttttaatgttgggttgaatttgctagtgaaaccatctgggtctcaattttttttttctttttgtttttttggaaagctttaaactatgtgttgaacttatttaatagttatagaattactcagaatatctatctcatcattggtgagctttggtagtttgaatttttcaagtaatcgattcatttcatctaagttactgaatttatgtgtaaagtgttatttgtagtgttattttattatccttttaatatctatggagtctataatgatattcctcttttattcttgttattggtaatttatgtctatctttttttctttatcagttttgtttgaggtttataaatttttaaatcttttcaaagaacaagatttggtttcattaattttctctattatttttctgttatcactcttattgatggggagctgatcattatttcttttttttctgcttgctttaggtttattttgttcttcttttcctaatttgttaagataaaagcttagatgattgattttagagttttattcttttctaatataagcattagcttctttgagtttccctctaagcactatgctagctgtgtgccataaattttgatacattgcattttagtttttatttggttcagactatcttctaatttctcattaaacttcctctttgaatgctggcttatttagaagttatttaatttctagtgtttggagtatttctgccatctttttgttacctatttctggttcaatttcattatgatcagagaacatactttgtatgatttcaattctctgcatatatttgatgtctagatatgagattttatctgtggtacttatcctggatagatttactaggttgtagattatgtcagtcttcagttttgctagaaaatgccaaattgtttttcaaagtttgaaagtatcaggggaacccaccccccgtatttcaacgtaggttctttatattttctgtaagtgtcggccagttgagaaataaagagaaagtacaaagagaggaattttacagctgggcctctggggatgacatcacgtatcggtaggaccatgatgcctacctgagccttaaagccagcaggttgtattaagatttcaaaaggagagggggtacaagaacagggagtaggtcacaagatcacatgcttcaaagggcaaaaaggagaacaaagatcacatgcttctgaggaaacagtacaagggcaaattcagaactactgattagggtctttgttcagctgtgcacgtattatcttgataaacatcttaaacaacagaaaacagggttgaagagcagagaactggtctgacctcaaattcaccagggtggggtttttccccaccctagtaagcctgagggtactgtagggaaccagggcatatttcagtccttatctcaaccgcataagacacttgcagagcagcgtttatagacctccccccagggatgcattcctttcccagagtcttcattattaatattccttgctaggaaaataatttagtgatatcttccctacttgcacatctgtttataggctctctgcaggaagaaaaatatggctctattctgcctgaacttgcaggcagtcagaccttatggttgtcttcccatgttccctaaaattgctgttactctgtttttttttcaaggtgcactgatttcatactgttcaaacacacatgttttataatcaatttgtacagttaacacaatagtggtcctgaggtgacgtacatcctcagcttacgaagatgacaggattaagagattaaagtaagacaggcataagaaattataaaagtattaattttgggaactgataaatgtccatattaaaatgaaatcttcacaatttatgttcagagattgcagtaaagacaggcgtaagaaattataaaagtattaattttgggaactgatatatgtccatattaaaatgaaatcttcacaatttatgttcctctgccgcagctccagccggtccctccgttcagtgtccctgacttcccgcaacatgaaagtagttgtacgaatctattgcaccactccccctgccccagaatgggatatgaatgttctatatcctccctaaacctactatgtatttgatttattcattattctagtcttggaagacaattaatcactaagggaacatttttctcatctttttttttttttttttttttttttttaagacagagtcttgctctgttacctgggctggagtgcagtggcacaatctcggctccctgaaacctccatctcctgggttcaagtgctttttctccctcagcttcccaagtagctgggattacagacgtgcaccaccatgcctggctaatttttgtatttttagtagagacagggtttcaccatgttggctaggctggtcttgaactcctgacctcaggtgatccacgcgccttgacctcccaaagtgctaggattacaggcatgagccactgcacctggcctcatctttcgtgagttaagttttatatcatccttgataatttagggtatcacagtaagcatactgaagttgaaaactcaagtaggttttggttatcattccaaacgacttgaagtttctcattggtcatggagttttggctgtgaaacaggacctggggctgcctctagccagagtgattctacctatgccacaggtggacaggtaagcccttttatggttgctgaaataagtccatatcctagagatgagattagattttcaccaatatctacttccagtcttcatgctttaaatgttgaagttcttcagttttgtacaggtaaaagaaattcttcacctaattctaagtttttacctaacttcttcaaccagtcttttcattgcctgatggaattctgcctgggttttaaattcttttaaatttaaaaatttttttacgttcttcctatctgacaaagacacaagtcttccattcgaattctacaaatctcttatacctttatctgagtctatattttcaacccttatgtgctaatgacaaatatttaattccatccttaaaggatagttgattgtgggcatctactgtatttcataacctttgtaatacaagttatataatttttagtgcttaaactatactttaaagaaaataataacagtgattagtagaacttagccttgaattaatttgagactgttgaaatagtggtgaacttttaagacgcagaggaaagtttttcctttggggataagttattttaacctgagacattttaaatgacaggaaaacatctagctttctttttttatgagtgattaaaatttaaagaggaaagtaaagactgaattggctttatacttactttaaattttaaattaccttaccatctatttaacttaaaaataagccacttttattattcagttaacaaactgaatatcattctttgtttttatttttattttttttaaagacagagtctcgctgtgtcgcccaagctggagtgcagtggcatgatcttagctcactgcaagctctgcctcctgggttcatgccattctcctgtctcagcatccctagtagctgggactacaggcgcccgccaccatggctggctaattttttgtatttttattagagacggtgtttcaccgtgttagccaggatggtctggatctcctgaccttgtgatccacctgcctcggccttccaaagtgctgggattacaggcgtgagccaccacgcctggccattcttttattaaaatattttttatagtaaaaatgcaggtgtattatgttatatttattcgttttggtaatatggttttattaaacttgacgaaaatgccttccaactatccatgtgttactcagaggtatgagaatgaattagccgaacaatttgaacaaaagttaagataatagacatttagaatgcttcttgctagaatgaagttctgatttgtgaagaatattactttatcaggtagggaagatatataaaggcagaaaaattattaaattgtgacttcctaaatgtctacttaaaaacatttatggtaaatttataatgttatattgaattgatttgaattatttgaatcttaaaatatagtgtgggagcttttttctaaagtatatattattaaaagctgagaaatatttaagtggttgaaagccagtgggaaatatgaagcaaactgctaatgcaactggggagacaatagaactatgtttatttaatattaagcattaaacttatgaagattttactggaaatttgattggtttttctgtcacccaagggtattttaagcctgttttatgcattatacctgggctgtaccaagagcagatggcaagttcccaggggaactttccaactgacccataatttgagataagatgatagtttacagagctacaaaaatagtcttggggtttgccactgtttttgttttagttgcctatcagatcttttgtcaccttttctctcacagatcatatggatgacatacagttctgtttatttgtcaatatctaattgattagcataaagttataagattataattcaagaggtgaaatggatgctaattggaactcctattaggaatttgctcatcaacatacaatttctttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagttttctgaacagatacgatgaaaattatctactaagagtttaaaatatatcgctgagggttaaaataaagttcaaagtactcccaagtattatgggaatttgtctgtttcttgggaagcagggtagacgttatctaggtggaaaagacgagtgggcaatttgaaatgttagactaggagcttggaaagagagaataaggctagagttatactctagaagttactcagtatattttattgaaggcctaatatatgtcctttaagattgaagccctggaattcatgcagaccacaagactagcatctcctttgcttgtggaattgatagtctagttactagattctagagggaggattatttgctttgaaggtcataggtgaagcttgggaatggatgagactgaaaaaaaagagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaattttgtatttgtaattttgcttccttttttttttttttttaaagaaggccccctaaattctagaaggttcaggcccaacaatacctgggaggcacagaatcatggaagttaagaggagacaaatcacggatggagaatatgtactcttttaaatgatgcattggggtagctaaggaaggcagttgcatttggcaattcagggattattgataatcttcactaatgagtatgaatttgggagtgggaagtggaggttgtgtactttttaaagaaagtggcagtagagtccaagaacagtagcttttgaggaaagcaaggtccagggaagtttttttgtatgtgtgcatgcttcaaaggtaggtggacatctaaatacgttaaaggaagggaaaacatgcaaatagcacagaaggaaaaattaaaggcaatagcaagagaggttaaagcagtgtagaaatagtgacgagagcagggaggaaaaaggaaatgaggtcaagacataggagtgttctaaatagtagaattcagtaaaggtgatttaattgttactgtattagcactgtgctagtgctgagtgcaataattgattttcataatgctgtaatttttctgcaaatcaacattttatgcttagttcattaagatttattatacaatttataaagacttacaatcacataatttataaagattttcatttggatgtttaaaatgaaatgtttcatgacatagttggaagataattatcttaattatctaattagttgaatatgttaaaattaatcttccagaattttttgacttattaagtgattgccccaaatcagcttagagatattatcaagtattttgctagtaagttatgtaaactaattaatagaaaatacatgaaataatcttattttctcttagttttatagatggtatggaaaaaggtacagaattgtcaggtaggatatttattattattttttccatttaactcatcaaaatgtattgaatgtttattatatgccaggagcaggtctaggtgctggagatagagcagtgaacaacacaaaatttctgccttcatggaatttacattttagtggaagagacagaatataagcaaataagcatgtacgtatatattgtcagatagtaatgtgtgttacaaagaaaaataagggagagtaaggcgacagagagttgtataggatgatatttcagatagtgtggtaaggaaagccaggtaggacacttatatgttgctttttgtcagtgtatttagaaaactattttatgcaagtcaaattgtgtttactaagatcaaatcatttacaatttaataggagcaacatctgcttacctgagttttcccttctgaaattattgatttataatagtaccaggctaggtgtggtggctcatgcctgtaatcccagtactttgggaggctgaggtgggagaattgcttgggtgcaggagtttgagaccagcctgggcaagatgctgagacccccatctctacaaaaataaataattaaaaatcagccaggcatggtggcatgtatctgtagtcccaactacttgagaggctgaggcaggaggatcctttgagcccaggaatttgaggctgcagtaagctatgaccatgccattgcactccagcctgggtgacaaagcaagaccctatctctaaaaatgatatatataataataatagtatctacaccataggtttgttgcatggtttaaataagattttgtatgactgttttggtgcagtgctcttactcttcactttatatgaagtatgcctgtaaaagggaataaaacttagtatgtttcgcagatactgtgtttttcacaaattggaggtttgtggcagcgctgtgttgagcaagtctgttggcaccatttttcttacagcatatgctcactttgtatcttcgtatcacattttggtaattcttgcgaaaaatttttaattttttattagtatatctattatgactatttgtgatcagcgatctttgatgttactactgtaattgttttggggcaacacgaatcactgcacccagagaagagagctaacttaattgataaatgtgtgggttctgactgctctaccagctggctcttcccctatctttctcccctgtccttggacctccctattccctgagacactgcaataatgaaaatgggccgattaataatcctacagtggcctctcagtgctcaagagaaagcaatagttgcacatttcttaccttaaatagaaagccagaatgattggaccttagtgaggaaggcatgtggaaagctgacatacaccaaaatgctaggcttcttgagccaaacagttagtcaagctgtgaatgcaaaggaaaagttcttgaaggaaattaaaagcgcttctccagtgaacacaaaaatggaagtgaccagctttactgctgatacggagaagttcgagtggtctggatagaaaatcaaaccagtcagaacatttccttaaaccaaagcctatcccagatccaggccctaactctcttcaattctgtgaaggctgagagaagtaaggaagctgcaggagaaaagtttgaagctagcggaggttagttcatgaggttttagcaactatctccataacataaaagtgcaaggtgaagcagcaagtgctgatggagaagctgcagcaagttatctagaacatctagctaaggtaagtggaaggtggctgcactaaacaacagattttcaacgtaggtaaatcagccttctattggaagaagatgctaggactttctagctagagagaagaggtcaatgcctggtttcaaagctttgaagcctaggctgactgtcttgttagagactaatgcagctgataactttaagttgatgccagtgctcatttcccattctgaaaatcctagggcccttaagaattatggtaaatctactctacttgagccctgtaagcagaacaacaaagcctagatgacagcacatctgttggtagcatagtttactgaatattttaagtccactgttgagatctactgctcaaaaaaatatattcctttcaaaatattactgctcattgacagtgcagctagtcgtcgtccaagagctctgatggagatgtacaaggagataaatgttgttttcatgcctgcaaacataacatccattctgcagcccatggatcaaggagtaattttgactttcaaatcttattatttcagaattacatcttataaggctatagctgccatagattgatggatgtgtgcaaagtaattgaaaaacctggaaaggattgaccattctagatgcccttaagaacatttgtgattcatgggaggagatcagaatattgacattaacaggaatttggaagaagttgattccagccctcatgagtgactttgaggggttcaagatgttagtggaggaagtaactgcagatgtgatggaaatagcaagggaataaatagagcctgaagatgtgactgaattacttcagtgtcatgaaaaaacttgaacatatgagtagttactttttatggatgagcaaagaaagtggattcttgagatggaatctacttctgataaagatgctgtgaacattgttgaaatgacaacaatgggtttacataaacttagtggataaagcagtggcagcatttgagaaaattgactccaattttaaaagaagttctagtatggataaaatgaagcattggatgctccagagaagttcttcccgaaaggaagagtcaattgatgtggcacacttcactgttgtcttgttttaagaaattgccacaggccaccctgccttcagcaaccaccaccctgataagtcagcagccatcagtattgaggcaagacctcccaccagcaaaagaactacagtttgctgaaggcttagatgatcattaacattttttagcaatagagtatttttagattaaggtatgtacattgttctttaagacataatgctacttagcactttactacagtatagtgtaaatatacttacagtatagtgtaaatatactttttatgcactgggaaaccaaaaaattcatgtgacatgctttattctgatactcactttatttcagtggtccagaaccacatttacagtatctccaaggtatgcttgcatttcttgtctgcttttatgtgaaccaaataagttataatcctctattaaatacctttcttttctgtagatacctccaaattacagaatgaagcttctgtgttttttcaacttggagattaaataatggttttaaattgaggcacatgcatatactgtaaggtatattagtctcagatatactactcagtgaatattttcttagatacatacctatatagtcgccacacagatccaagtatgccgtattcccagcacaccagaagaaatctttgttcaccctttgagtcattactaccttctgtaggtatccactgttctgacttccatttccatcaatttgttttctcgtttttcaatttcatatttctgacttctatttccatttctattttatgaaaattcaaaaaaggcaaaacaattttatttatttatggtttgttatcttttttatctggcttcatttgctgaaaacaactcctacaaaattcatccacattgttacgttatcaccagtttgttgggtttcagttctgtgtagtgttccatagtttgaatggaccacaatttatttattcattttctagtttatggacgtttggattatttttattttgagggagtagttatggataaagcttgtgtgagcatttttatacatcattttggtagacatatgtactaattttgttggctatatacaaggagtgggtttactgagtcatagggtaggtatatgtatttttaaaataattattttattttttttaagttctggggtacatgttcaggatgtgcaggttacatagataaacatgtgccatggtagtttactggacctgttaacccatcacctaggtattaagcccagcatgttttagctcttttccctaatgctctgcttccccaccctcccccaacaggccccagcaagtattgttcccctccctgtgtccatgtgttctcactgtttggctcccacttataagtaagaacatgcagtgtttggttttctcttcctgcgttagtttgctagaataatggcttccagcttcatccatgtccctacaaaggacatgatctcattccttttaatggctgcatactattccatcatgtgtatgcaccattttctttatccagtctatcattgatgggcatttgggttgattccatgtctttgctattgtgaatcgtgctgcagtgaacatatgtgtgcatgtataatatactgatttatattcctttgagtatatactaagtaatgggattgctgggtcaaatggtatttccggttctaaatcttggcggaattgccacgctgtcttccacaatggttgaactaatttacattctcatcaaccatgtaaaagtgttcctgtttctccacaaccttgccagcatttgttgtttcttgactttttaaataaccaccattctgtctggcgtgagatggtatctcattgtggttttgatttgcatttctctaatgatcagtgatgttgagctgtttttcgtatgtctgttggctacatgtatgtctttttttgagaagtgtctgttcatatcctttgtagggtaggtatacgtttaacttcagtagaaactccaagcagtttcccaagttgtaccagtgtattcacccaaaagcattaggtgagagtttcatttgcttcacattctcaagaacacttccagtgagtgaagtctttcgccattctgggaggtgtatatttgtgtatcattgtcattttaatttgcatttctatggtgctgatgatgcgcgagtgcttctatatatgttgactggccatttggatattgatattctcttttgtgaaatttctctttagatctttacccctttaaaaaattggattgtttgccttatttattattgatttatagtaattctttatattatgtattttatatacaaaacttttgtgggatatatgtattgggaatatcttctcctggtctgtggcttatctcttactgttttaatcttaatggtgtcttttagagaacaaaagttcctagttttcatgaagtccaacttatttttttctttagtagtttagtgcttttgaatattaatttacaaaatctttgcctacaggaagatcacaaagatattgtcctacattttgttctagaagttttatagatttatctttcactttttttttaggcagggtcttgctctgtcactcaggttggagtgcagtggtgcaaatatagctcagtgcaaccttgacctcctgggctcaagtgagcctcctgcctccgcctcccttgtaattgggaccactgtgcatgccaccatgtccagcaattttttgatttatttttatagaggtagggtcttaccatgttgcccagcctggcctcacactcctgggctcaaaggatcctcccgccttgaccttccaaggtgcagagtctatagctgtgagccaccacacctggctacctttcacttttagatatgtgatctagaattaatttttgttcatggtgtgcaattgggattaaggtttttgtttgtttgtttgttttactggtttacagtgctctagcaccattaattgaaaagattgtcttttcccttcagactttcagtggtctttttcataaactaagtgactgtttatatgtggatctgtttttggactctgttccattggtctatttatgcattctttggttgttgtcagactctccaatataataaattttgaagtctggtagtgtcagttctcaactttgttcttaaagattgccttggctagtctaggacctttgcatttgtatgtaatttttaggatccttaggtcaatttccacaaaaaaacttaatggaattttgatttggtttgcattgtatctatagattaatttggggaggattggcatcatagcaatattgagtcttttgaaccatgagcatgatatatttctccatttatttacatcttaaaatttttttctcaatttttagttttcagttgtagatgtctttattcattggtattttattttcttatgttattgtataagtggtgtttcataaatttcatgtttgattgttgttgttagaaatagaaatagaaaaatcttgagcttgtattaaacaaccttactaaatttgcttattcgttgtagttggtatataatcatgttacctgttttctttttgatctttatactttcccacccttttattgcctgttttcctgactataacctttagtataatgttgaatagaagtgatgatagtggacaatcttcttttctctttaacctttggggaagtattgaacattttaccaatctaataaatagattggtattagtggtaggtttgtgtgtatgtgtgtgtatattattattactattatttttggtaatagctaccttttatcagattaaggaagttcccttccattcctaggttaccaagagctttttttaaaaaaacgataaatgaatgttaaattctatcaaatactttttctgcatctattgagatgatcctagaatttctctgcttaattttgttaatgtagtgaattactttttaaaaaaattttaatttctttttaaagatgggtctcacttcactgtgcctggatattacttaggtttatttttgaatgttgaaccaacactgtattcttggaataaaccccacttgattatgtatattatgtatattatccttatatattgctgggttttctttgctaaattatcatttttatttttaaaagttttcatctgtgttcatgagagatgttagcctataattttcttttcttgtgtccatatcatgtatgcatattattaggcttatgctggcctcacacagtgcttaggaagtgttttcttctctttctattggctagaaaaatagtacaagattgatttctgttatttttaatctgtatgataatctctttttctctttttaaaatttgtgaaatagtcatcaaaatagagtatggttgtcttcttttgcagctgaagaaactgaagcttatagaatttaagtactattagatagctggtggttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgataatggtgttatttgcccaaagaacttttcttgctcaaagaactgcctatattgctttcttgctaacttgttaaagactagtatataataggctattacatagaggatgaatgcctggaaaaagaaataaaaattatgatttttttaaggaagatctctgagtttaagattttttccatgtcacattattatttctagtgatgctatagggataccgtattgcaagtaaacatctatagatgtacaaagaaaatttgcagtcttaattttaattagaaaccatttaccacatttagaagctctgattaaagatataatggataaaagggataaaattacatttgcagttatttgtttttaatctttaatgtcccttcttatatgactctcagatagagtgagcagggcccaacttgtctgaagcttaagaggtgacccagaatataattgagaggactagaaaggtatattagactattcttgcattgctataaagaaatatctgagatggagtaatttataagaaaagaagtttaattggcttacagttctgcaggctgtacaggaagcatagtgctggcatctgcttctggggaggcctcaggaagttttactcatggcggaaggtgaagtgggagcaggcacatcatatggccagagcaggagcaagagagtctggtgcgggaggtgccggactttgcaacaatcatatctcaagagaactcactcattattgcaaggatagcaccaagccatgaggaacccgcccccatgacctaaacccctcccaccaggtcccacctccaacattggggattacaattcaacatgagatttgtaggggacatccaaactatatcaaagggcaatggatcagtgtcagcattcactgctggtaaaaacagtatttgtattcttaatttggttagtctggataggagccaaagattcacagcatggccgtattcacttggaagtttgcaatttgattaaggtttgagaacatgtcagggaaggaaagaatttcctttaaaatcatcctgcacactgaatacctaaagtagtacaaataatttgttatggcctgagaagctaagaaaaaatttagtcattcttctaagtccaagaatggctgtaggggatagtacatgagtgactatcctgtctacttctgttttctgttttattttgtatattttttagaaacaggatctttctctgtcccccacactggagtgcggtaatgcgatcatagctcactgtaacctccaactcctgggctcaagctgtcctcctgcctcagcctcccaagtagctaggactacagacgtgtgccaccacacctagctaattttttattttttgtagagacagggtcttactatattggctaggctgctcttgaactcctggcctcaagcaattctcttgtcttgggctcccaaagcactgagattataggagtgagccaccacgcccaatcctgttttcttttttgaggtgcgttaaatatttacattttacctggagtttggaaaagtagtttatttggacgtacaagcttgttttttttttttttttttttttttttgagatggagtcttgtcctgttgcctgtgctggagtgcagtggcatgatcttggctcactacagtctccgcctcgcaggttcaagtgattctcctgcctcagcctcccgagtagctcggcttacaggtgcacagcaccacacccagctaatttttgtatttttaatagtgacagggtttaactatgttgggcaggctggtcttggactcctgacctcaagtgatcctcctgccttggcctcccaaagtgttgggattacaggcatgagccactgcgcctggccaaggtgtgtttttaaagtagaagttaattctgtggattgatttaaccaattttctttgcaagcaattgtataggagaattaaatacaaatcctcctactgatgtcagatttagataatgccttaatatgatgtaatatcttaaatagtgaactgtttggttataccttgtgccatgatttccttaatatatctcataaagttgtacaaagaataagattgagatgctttactgttaggcacatagacatttatgtaacattcattttaaaaaatttgaataccaattatgtgtaaggtactaggataaacacaaaggatacaagaagtctttgccttaggccaatacattctgatagagtgttaaaatagttacacaagtatctgttactcaaagcattaattacataggtgttatatatattaagtatataaacattatgtatattaagtgccttgtgctgagtatcaactaagtgttttaagatcagagtccatttggggtttgtgatggttaattttatgtgtgaacctcactggatcacgggatgaccagatatttggtcaaatattattctgagtttctatgagagtgtttttggatgagatagatggattatgagtagagcaaaaaggcagactctcccacatataagagagaattctttcctacctgactgccttcaaactgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctttacacacacacacacacacacacacacacacactcacacacatactattgtttctgtttccctggagaactgtaattaataaagggtgacttggaaaggcatcacagaggaggtggaatttaagccagaggctaaactatcgtataagcaggatttcagtagataaagatggtgaagaaaaacactacaggcagaggaaatagggtatgtgatggaagcagtctcaagtagtataatttggctagagttcaagatgtttctactgtttttttgcatttcagaagagttgtgggagaacaccagttttaccacaacctggctagtacttggtggtagtgtggtagtggcagtggcagtgcgcgtgtgactttttttttaaaaaatgactgtagcaggttgattgatgattggttaaagaggaagtctgctttctcagcattctggttaatctaacctgagatcatttttcattactctatcatgctccagtccaggggaggggagggttatagtcagaaaaaaagaccgtataaatgtgtatatatatgtgtgtgtcttgctatttgtattggttctcatagtttgcaaagtgaatatgatgacattcttcccttggccctatttttagcttgcttttctcttagtggacctaagttatgaaatagcaaaggtttatatagctttgaaattcatgtttttagctgggcgtggtggcagtgcctgtcgtcccagctactcagggtattgaggcaggaggatcatttgagcctgggagctccaggctgcagtgagccatgcctacacctctgcattccagcctgggtgacccagctaaaccctgtctcaaaaaaaaaaaaaaaaaaaagaaatacatgttttataccctcagatttaattgcttattttacatatttgaccatccatttcctgggatgactgatgccccaagatggtgccaatgtggaatggcagtactgtttagtaggactttctccagtgtccagtgtggtatccaccagccacacatagctattgagtccttgacatatggctagtgtggctgaaaaatggaattttaagttttatttaattttaattgatttaaatttaaattgtaacatatagctagtggttactgtatgagacattgcagttctggagcttaagaagttttggcttgtttctagctctctggtgttgagaagggctgaccaagcagtattttcactcatatttaaaatataatatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggtagcgtgatgcctccagcttttttcttttggcttaggattgacttggcgatgcgggctcctttttggttccatatgaactttaaagtagttttttccaattctgtgaagaaagtcattggtagcttgatggggatggcattggatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgagggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaaccctacaagccagaagagagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcatgtgcagagacacacataggctgaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagtggacctaatagacatctacagaactctccaccccaaatcaacagaatatacgtttttttcagcaccacaccacacctattccaaaattgaccacatagttggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaacacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatctatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgagaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagagactaccatcagagtgaacaggcaacctacaacctgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcatcatcactggccatcagagaaatgcaaatcaaaacactatgagataccatctcacaccagttagaatggcaatcattaaaaagtcaggaaacagcaggtgctggagaggatgtggagaaataggaacacttttacactgttggtgggactgtaaactagtacaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccgacccaaatgtccaacaatgatagactggatgaagaaaatgtggcacatatacaccatggaatactatgcagccataaaaaaggatgagttcatgtcctttctagggacatggatgaaattggaaaccatcattctcagtaaactatcgcaagaacaaaaaaccaaacaccgcatattctcactcataggtgggaattgaacaatgagatcacatggtcacaggaaggggaatatcacactctgtggactgtggtgcgggtgggggcaggggggaggggtagcattgggagatatacctaatgctagatgacgagttagtgggtgcagcacaccagcatggcacatgtatacatatgtaactaacctgcgcaatgtgcacatgtaccctaaaacttaaagtataattaaaaaaaaaaaaaaagaaaatgtggcacatatacaccatggaatactgtgcagccgtaaaaaatgatgagttcatgtcctttgtagggacatggatgaagctggaaaccagtctcagcaaactatcgccaggacaaaaaacaaaacaccgcatgttctcactcataggtgggaattaaacaatgagaacacatggacacaggaaggggaacatcacacaccagggcctgttgtggaatagggggacgggggagggaatagcattaggagatatgcctaatgttaaatgacgagttaatgggtgcagcacaccaacatggcacatgtatacatatgtaacaaacctgcacgttgtgcacatgtaccttaaaacttaaagtataattaaaaaaaaaagaaaaggggaaaaatctaggaaagtctagtcgagggtagcaaaaaatccatctgtgtcaactggcagatagagtaaaaaaaataaatccaataaaaaaataacatttttatgtaatgagacatgccattgagtcaagagagaaactttttccaaagacgaaacaaggagaaatttattccgttttgtaagatttgttgagtagtatagtggacggcatcgtttaatagcaattttacaaataatagagacatttttatcatatatttacatcaaatcttggtaaaaagttttttgaagagctaaagcctgccaataaccatgtgagcgagctgagaagcagattctgcagagctagtttagtcttgagatgactgcagtcctggctgacagtttgattataacctcatgagagaacttgaaccagaggcactcagctaagccactttcagattcttgacccacagaaactgagataaaaaatgtttgttgttttaagctgcttagttttggggtaatttttttatgtagaagaagctaactatgttatgatattttttttagaatggaggtgcttggtgttaaatgataaatagatacagctttctaaaccttcaaatcttatttatgaaagtacatttatagccttatatgtttgagggtgtaaatatagttaggaaaaatgttgaaattaagtattttcactagccatcctaaatggcatctggccatttgaatgaatgaaaaatagctaataacaatagataacatgtattgaactctttctctgtttcagaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactccagcctgggcaatagagtgagactccatctcaaaaaaaaaaacaaaaaccagtaaaagcaagtttttattgttgaagagcaatggtatgcttacaaactgaaagaagggcaacaaggttatagcacagaaaacaaaaagaagagtggtgtgagattaggctggaaagatatgcatgggccagactagcaaggccttggaaggtgatgttttattctacttcctaagggaagctatcgaaaagtttttaacagatattatgttaaggttttctttttggaaatatcattgtagttaaaatatggacattgtagacatgccatagtggctatggggagactcttaggaagctgttgaaataaccaaacaaaaaagatggactaaggtattggcaaaagttttttcagaaatggagagaaatagacttgaaagatggttacaggataaaatcaacaggacttggtgagaaaattgattaccagggggttggggagaaggcattgttaagaatggtgaaaagatttcctacttgcctatctgtgtgtatgatgatgctatttattaagggtacagaacattaataggaagggggacacatttggtggtaaaactcattagttagcttttgccgaatttgagatatgtttgagacatccaagtttggaatgttgagaaagatgtacaggttgaacatccctaatctgaaaatccaaaatcagaaatgctccaaaatctgaagctttttgaatgcctataagatgcttgaaggtcatgctcaaaggaaatgctcatttggagcatttcagattttggatatttggattagcgttgctcagccagtgtaatggaattatgttattctaaattctgaaatatgaaacacttctgatctcaagcatttcagatcaggatactcaacctgtattagattggatcacacagaactccaggccagagataagaatgttcaaggaatgggcaaatatatggtaattgatgtaatggttaagaatgccttgtgagagggagtgagaagagaagaaggcctagaagttgaggaactccaatattaactggccaaactgaagaggataacctacaaaggatatagtagaaggattctttcactcatttatttatttattcaacagatatttatcaagtgcctattatataccaggcacaaatatggaatccagggatatagcagggataagatagtcaagatctttgctgtcatggaacctaaactgtagtagaaagtacgtaaataaacataaatactttagataggtacaggtactaaaaggaaatagaaaaggattatgtgactgaggaagggaagactagaagaggaacaaggcttttgaggaaaatcaagaacttccttctttttagccatgctacttttgaggtatctatatccaaatccaagtgattaataggggctgctgcatgctagtaaatagcaccaccattcacccaaattggcaggctcaaacttccagcagcttttttctttctttcgttctttctttctctttctttttctttctttctttttctttctttctttctttctctttctttctttctttctttttctttctttctttctttcttctttctcctctctctttctcctttcttccttccttccttccttgcttccttctttctctttttcttttcccttccttccttccttccctccctccacccctccctcctttcctccctctgtccccctttccctttccctccccctcccccttcccttccccctccttctccccttcccttcccctcccctcccctctccctcctcctgcctattctctcccctctccctccctcccccttccctcccctcccctctcctgttctctcctctcctttcctttcctttttctctctctctttcttatactccatattcagtccattagcagctcctgactactccatctttaacatttgtgctcaatatgattacttcaattatatgcactatttctttactctaagccaccattttctcttgcctagactattggagtaacctctgttctgatctcccagcttccaatcttgtccccatataatctggtattcacattgcagcccgaatgatcttttaaaaaccaaaattctttgatcatatgctccagttgtttcctataatatcgacacagtttaccatggcaataatgctctatatgatctagtcacttttttgactgcattttggaatgctctttccctctacttcagcttcactggccaagactccgctattccttgaagatatcagtattattccagacttcagggcatttgcatttgctgttttttcacttggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttctttttgttataactcttcagtaaattaagcctttgcctttcttgctgattttaccgtattatataactatcatagatgatttcaaatgttaatagtgatagaaactgtaataatataatactaacatgtattgatatttactatgtggggtcttttgaagaaatttacatttttttaacttaatattcaaaacaaccatgggaggcaggtgctattattatcctcagtagaggatctaaggatctgaggttcagagggcttaggtaatttcctcaagatcatatagttcataagtggctacaggtatgattgtagagcttttgctgttagccaccatgctattctgtctttaagttaacaaagtaaatgtttcatcttctaattatgttaaactaatatgcctttggtgaattgttttggtaaagttaatacttctttttctccacttttatatctgttatgtgaatttatgtcttagactggattattggtaactctattatttttacaataatcaaatgttagggctagatgggacatttaattacataatgaatggaataaaaatctgctaatcagatagatctgttttctaaactgcattttttctcctttgtcttttttggcctaccctgttggctgtgaactttattttaaaattcatttgtgcttataacaataataagcactatttattccttgagtggttttacaaaccttacaaggcttaccatttccagagtgtcagagtagctatagcaggtttacacttaaatatactcttggttttatgacattccattttgacagtgatgaagagcatgcttataggcatcgttgaaaaggaatgttagaactgtttatgtgatagttctacaagtttcttacatttatctattatagaaagatctatcatacatgcttacttttcacagagtttataatatatgcatatgttttaatggtttgttataaataatatgattagctggcaaaagcttttagcaatttaaattttggggttattttaaattatgaatttaaacaagctctttcatttcaggtggttggctaaacccactgtggctgatagtgttatataaagttgttttctagttttgaaaagctaaaagtttatgtttttatgctttctgtgaaagtcactaatacttgtaacctaatgaaaatgtttctactgctacaattgtggagaaattttgaaaacctagatttagtcagtatttttcatgctaacattgtaaagaatgtcagaggccatggagaggatctaagggaatcagagaaaaggaagaggaagtaacatttttagagtacattttatgttctaggcaactcagtaatagggcagtatatcatttcattctcacagaagtctttcgaggtattataatttcccttttacagatgaggaaactgaggttgcagaggttaattatgttgataaagatcatatagataagtagaactaggattgaaatctagatctacttgatacttaagcttcctcttacacttgttttatggagttgttcttgggccttcttaaacaggtaattattctatgtcatagcagaattcttgatagaattatgatatttaaatttttatttactcagctatcataaacataaaaatactatactactatataagcttgcaggtcttttgaatataaaaactaaactgcatgttgactcatttatcagagttctgtagaataattaaaagtaattataggaggtcttttttaagtgtatgtagtcatttgtattatttgaaagcttagacagcttttatagcagtttgcttccagaccatgctcattgatgcattgaagagatacccgtgaaccaccttgtctactcccatacagctgatttatctttgtagcagtccctgagttagagaatcttccctactacctctgctatagttttcagtaaattgggcaagatcaaatgtttcctggagataatttccttagctcttgtattagatcccaacagtaaatacattattgactgatgtgaacacagaaagcatctcaaactttttgttgatcagagcatagctcagttgttttaggaattccagataaaatgacagtaatgtattgtgattatttccttcttttgaaatgaacttgaatatacttttatgtttatttgtaaaataacatttcaaagatcacattgtgcttatttttacagtggcctctggctgaaagcaataaagttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctttccatttcattcttttataaattcttttaacattattgttgcataagagaaaaaggcataaattattttaaaattttagattcagagacttggttggacacatgatattactctggatgttcttagacgtttcaggccatttcaaccttattttagttattactttaacaagtttctgcaaagttgtggttgtattaatagcaaacatactaatagtgctatttgagcattatcagatatcataaacatagtattctatcccttcttctgaaagatatatcaacatttccctagatatatccttatctttgtactcactttggagaatgagctctaaaagtataatggaaggaacaaaaactttagagccagatttgggatcagatgtgacctctgtcactctgtcatcatcatttggtatctaacattagcagttattctcattttagatatgataaaactgaatcatagagaggttaagtagctcaagacttttaaattaaacatgaacgattaaacattaaaaagtatccagaaaaattaacttactttttttctaaatgtagtataaatatttttagtgcatctcaagtatgcagtgacttagatacccatattccaattacagatgtctaattttttaacttacatacaggaacaggtaatcatgttagatcagtttgtctcagttccttgtgttttatgtttagaatgttggggatattttgttcatattctaaataactatttgttatacccttccaccatcatttaatatgttaaagttttaaagcattttactttgatttttttttttttttttttttgagacagagtcttgctctgttgcccaggctggagtgcagtggcactatctcggctcactgcaagttccgcgtcccgagttcacgccattctcctgcctcagcctcccgagtagctgggactgcaggtgcccgccaccacacccggctacttttttgtatttttagtagagacggggtttcatcgtgttagccaggatggtctcgatctcctgacctcgtgatctgcccacttcagcctcccaaagtgctgagattacaggtgtgagccaccacgcctggcctttactttgattttttaaccttacaacaccccttgtacttgtataatgtcatttttacagatgtgggaaattaggaatatagattaaaaatgacatagttataaggctatagtttagttctcacagagaaactcagtcatataagttaagcgtttttgttcccaaatgatagtcatagtagtaaaagaaatttttaaatttcacttatttattcagaaagtgcttactgagcgcctagtgtgttctgtgcactgacttaagtgctggagatacctaagtaaatcagacgatttctgctgtcatggagcttatacacttatagagggaagtagaaaataaatgtaaaaaatattttcaccttttgataagtaagtgctgtggaggaaaattaagcaaggaagggtaaaggggaattctaggggttaggaaaggggagttataattttaaacagaattattgaggaagacatcactaggaaggtgacatctgagcaacaaaagacctaaaggaggtatgggaaggagacatgcggatgtcttggagaagaacattataggtagagagaagagcgaaagtccaaggccctgagaatgcagcatgtctgacacgttcaaggtgaggcaaggtgcaggtggggggcagtatgttgaaagcaaggtaagcaaagggaagagtaaaaggaaatgagatgaaaataatgaaaaagcatacgaaagcaagtgattttttcttgggtctagatttcatactggtacctaactttgcttaatttttctgttgttaataggagctgttaatgcccagtcaatatatcagagaatggagtttgagcaactatagtttaatgaggcaattaaattgagaaccgtggctttagactagttcaatatgaagaacagattaaatgtactctgaggaactgccttttaattatagatttttgagattcattttagtgtcatttttttcatggttaaacaacatggagaggaaagtaatgatcttataaaatagaagtgttcaagataacttactaggatggatcatctgtgtttgccaaatcaaacagggcaatttaaaatacagttgttccttggtatacatgggagattggttccaggactcttgagtatatccaaatctgcacatactcaggtcctacattagaccctgcagaacccacgtatacaagtttcacatcctgaacttactgtattttcagcccgtgtttggttgaagaaaagccatgtatataagtggacttctacagttcaaacctgtgttgttcaagagtcaactgtgtatcaggttagcatataaacctgttttgttttgcctaccataaaacactgatctttagattgatacaattgctgttttattcattggttcatatacacctaatgagattgctattttaattttcattgttaagacacacttaaattcctaatacttaaaaacgtatatgaaaaatttattttcacaaatcgatatacctattttttgaacagtagtatgcatattgctttacaaaatgacagtgtaaaaatggcattcagattcccgtttctaagatgcttgaacattttgatttttactcattagaagtttaattgttattagtcaacaaggagaaacaatgaggaacttacagaggagtgtcagttgtattgaaagattaggagtgaatgttttatcttgtaaaaagatatctcagcccctaggatggtctacagaaatgacaataagctccgattcttattttaattttttattttttctgtttctctgtctcctgtcttttcctgcgcattctctcttttactcccaacctctcttgtttatttctttggatccgtcaaagttggaaattgaacagtatttctgatatattatgtagtatgagttctgaaatcttggtgaattaaattcatgaatgctaccatagtgattttattaaggtgtggcttttgattacatgttcttcaagctagggttatgggagtcagctagtaggtaggcttagtttgattgtcctactttaacatttgtttttccttcttgaaataactttcatgaagttagatacaggcttttgtacaggatcattttgtgggaaatggtgggtctgaaaagtaagccattggtattgataaaagcagagagaaaatgaaaaagaaaaaaggtaggaaagatgtgccttttagccaataaatagaagtttaaaagacatgaaagaatgagatgtaatttttttaggagctctaatttagccatgaacacagccaccattactctgcagaaagggaaaaaaaggggattctgtttcagaatttgctgtattaaaaactatttgagaaagagaacactttattgaaaattgaaaattattggctaacattcagtgtgagggtatgtcgaagtaccatccgactaaaaacaaattaagtgtagtcgtgagtcaaacatattgtttcttccaaaatttaaattaaattagtttcatatgagtgttttctttttttcttgagacagggtcttgatctgctgcccaggctggagtgcagtggcatgatcacagctcactgtagctttggcctcccaggctcaagtgatcctcccacttcagcctcctgagtagctgttactacaggcatatgccactacacttggctaatttttaatttttttgtacaattgggggtcccactgtgtttcccaggctggtctggaactcctgggctcaagcgcctccagcctccagctcccaaagtgctgggtttacaggcatgagccactgcacccagccaattttatgtgttgataacaatcttgctgaacttactgtttcttataacttataggttgttcttcttgggattaccaagtaaatgtcctttgcagtagtgacactttttctttcttttcaatctaagattttgcttttttctctgattgtgtaaagttagcacttctaaaacaatactctcagcatgtattgcatgattacatactttttcttcttatattaataatatgaagtatattaattgaatgctcaatattgaattaatcttgaacttctggaatatgtcatataattctattcttttaaatgagttattatgaaaaattttaaccatacagaaaagttgaaatttattcggtggaaatctgtatatcctctgtcttaatttaacaattaacattttgctatatctcctctttttttttgttagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcataaatatgtataaatgtatatcgatcataatgcttgagaaggaatgggcattggacccatacctctgcactctggcttgaaggaagatgaaaagtttctagatacaacagaggaaatgataatatagagaagtccaggaggtacaaagtctgtgtgacaaagatagaaagtagaggaatgtgatacaaagggagaaataaaacctttgaatcttggagctatataataaatgttaagattcttcatactgaggttgtgaagcaggacaatagtgaagaggaatactgaagaaattataggagttttaaaaatgattacaagatatatcctatatagagagaatattacaatttctggtgaaaactatcaaatataaggggatattctccagaacgaaaaggtgaaagaaaacacctcattggcactatgtagaagaaatgggttgtaattatccaccactgcacctgccagccacgaatggctgtttaaacttcagttaaactagttaaaattacataaaataaaaaatctagtccctcagtcacactgaccacatttcaagtgctcaatagctatacatagctagtggctccatattagagtgttttcatcatcgaaaaaagtttaactggccatcactgcaatagattcaatataaaggtatgctggcttttagggtacacattcaaggtttggtagggagcctattaaaactgatcaaaatccttgattgttatttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagattaaagaagattatagaaaagtacttgattgattgttcataaacatattcaaatatcccaatacagatgaattttgtcctagggtattgagataacttacaaaggagattagcaaacagactatatatttttttaagacactatagagaaggagagaggttctggaatactggagatagatacatgccattctgattttcagaagggagaaatgaaggttccacaaacaataaatcaattggtttgacattgaccttagaaaagattaaaggggtgggttttgatcatctgagagagatagtagtggtcactaagaaaagattaaagaagtgggttctgaacacccaagagaggtagtagtggtcattaggagttagtatgggctcatggtgcataattgtgacagattgacttttcaagtccaccatgtactagctgtgcaacattgagtaatttgcttcatctatctgggtctcagctttcttatctttaaaatgaaaataaaaataatatctattacataggctcgtaataaagaataaatgaatttacatttgtaaaacatttagaacgaaatgtgatacataaaaagcacaatgtcagtgatagataaatagctagagagagaccaacaggctgccttctttttttttttttgagatggaatctcgctctttcacccaggctggactgcagtggtgcaatcttggctcactgcaatctcggcctcccgggttcacgctgttctcctgcctcagcctcctgagtagctgggactacaggcaggcgccctgccactatgcccagctaattttttgtgtttttagtagagacagggtttcactgtgttagccaggatggtctcgatcttctgacctcgtgatccgccagccttggcctcccaaagtgctgggattacaggcgtgagccactgcatccggccacaggctgccttctttaatcaaacttgtagctccgtgaaatgaaacagctaatgtgcaaagattgtagcagctcttctttaaaaaaattgaggtgaaatttgcatagcctaaaattaaccattttttttattattatactttaagttttagggtacacatgcacaatgtgcaggttagttacatatgtatacatgtgccatgctggtgtgctgcacccattaactcctcatttagcattagttatatctcctaatgctatcccttcccccctccccccaccccacaacagtccccagagtgtgatgttccccttcctgtgtccatgtgttctcattgttcaattcccatctatgagtgagaacatgcggtgtttggttttttgtccttggggtagtttactgagaatgatgatttccaatttcatccatgtgcctgcaaaggacatgaactcatcattttttaaggctgcatagtattccatggtgtatatgtgccacattttcttaatccagtctatcattgttgaacatttgggttggttccaagtctttgctattgtgaatagggccacaataaacatacgtgtgcatgtgtctttatagcagcatgatttatagtcctttgggtatatacccagtagtgggatggctgggtcaaatggtatttctagttctagatccctgaggaatcgccacactgacttccacaatggttgaactaatttatactcccaccaacagtgtaaaagtgttcctatttctacacatcctctgcagcatctgttgtttcctgactttttagtgatcgccattctaactggcgtgagatggtatctcattgtggttttgatttgcatttctctaatgaccagtgatgatgagctttctgtcatatgtctgttggctgcataaatgtcttcttttgagaagtgtctgttcatatcctttgcccactttttgatgggttgttttttcttgtaaatttgtttaagttctttgtagattctgaatattagccctttgttagatggatagattgcaaaaattttctcccattctctaggttgacttttcacttcttttgctgtgcagaagctcttgagtttaattagatcccatttgtcaattttggcttttgttgccattgctttttgtattttagtcatgaagtctttgcccatgcctatgtcctgaatggtattgcctaggttttcttctagggtttttatggttttaggtcttacgcttaagtctttaatccatcttgagttaatttttgtataaggtgtaagaaaggggtccagtttcagttttctccatatggctagccagttttcccaacaccatttattaaacaggatatcctttccccattgcttgtttttgccaggtttgtcaaagaccagatggttgcagatatatggtattatttctgaggctcctgctctgttccattggtcgatatctctgttttggtactagtaccatgctgttttggttactgtagccttgtaatatagtttgaagtcaggtagtgtgatgcctccagctttgttctttttgcttaggattgacttggctatgcaggcccttttttgggtttcatgtgaaatttaaagtagttttctctaattctgtgaagaaagtcaatggtagcttgatggggatagcactgaatctataaattaccttggacagtatggcccttttcacaatattgattcttcctaaccatgagcgtggaatgtgtttccatttgtttgtgtcctctcttatttccttgagcagtggtttgtagttttccttgaagaggtccttcacatcccttgtaagttggattcctaggtattttattctctttgtaacaattgtgaatggcagttcactcatgatttggctctctgtttgcctcttattggtatataggaatccttgtgatttttgcacactgactttgtatcctgagacttgcagaagttgcttatcagcttaaggagattttgggctgagatgatgggtttttctagatatggaatcatgtcatctacaaacagagacaatttgacttcctttcttcctatttgaataccctctatttctttctcttgcgtgattgccctggccagaacttccaatactttgttgactaggagtgctgagagagggcatccttgtcttgtgctggttttcaaatggaatgcttccagtttttgcccattcagtatgatattggctctgggtttgtcataaatagctcttattattttgagatacgttccatcgacacctagctcattgagagtttttagcatgaaggggtgttgaattttgtcgaaggccttttgtgcatctgttgagataatcatgtggtttttgtcattggttctgcttatgtgatggattacatttattgatttgtgtatgttgaactagccttgcatcccagggttgaagctggcttgattgtggtggataagctttttgatgtcctgctggattcggtttgccagtattttattgagaatttttgcatcgatgttcattaggtatattggccaaattttcttgttttgttgtgtctctgccaggttttggtatctggatgatgctaaactcataaaatgagttagggaggatttcctttttttctattgattggaatagtttcagaaggaatggcaccaactcatctttgtatctctggtagaattgggctgtgaatctgtctggtcctggactttttttggttggtaggctattaattactgcttcaatttcagaacttgttattggtctattcaaggatttgacttcttcctggtttagacttgggagggtgtatgtgtccgggaatttatccatttcttctagattttctagtttatttgcatagagatgtttatagtactctctgatggtagtttgtatttccatgggatcaggggtgatatcccctgtatcattttttattgagtctatttgattcttctctcttttcatctttattagtctggctagcggtctgtctattttggtaatgttttcaaaaaaccagctcctggattcactgattttttgaaagattttttgtgtctctatctccttcagttctgctctgatcttagttatttctggtcttctgctagcatttgaatttgtttgctcttgcttctctagtacttttaattgtgatgttagtgcatcgattgtagatcttttctgctttctcttgtaggcatttagtctgtaaattcctctctaaacactgctttggttctgtgccagagattctgatatgtagtgtctttgttctcattggtttcaaagaatttattcatttctgccttaatttccttatttacacagtagtcattcaggagcaggttgttcagtttccatgtagttgtgcggttttgagtgagtttcttaatcctaagttctaatttgattgcactgtggcctgagaaactgtttgttatgatttccattcttattcattttctgcagagtgttttacttccaattatatggtcaattttagaataaatgcgatgtggtgctgagaagaatgtatattccgttgatttggggtggggagttctgtagatgtgtattaggtctgcttggtccagagctgagttcaagtcttgaatttccttgttgattttctatcgtattgatctgtctaatattgtcagtggggtgttacagtctcccactattactgtgtcggagtctaagtctctttgtaggcctctaagacttggtattatgaatctgggtgctcgtgtattggctgcatatatatttaggatagttagctctttttgttgcattgatctgtttaccattatgtaatgcccttctttgtgtcttttgagctttgttggtttaaagtccgttttatcagagactaggattgcattttttttgctttccatttgcttggtaaatattctgctatctttttttgagcctatgtgtttttgcatatgagatgggtctcctgaatacagcacatcaatgggtcttgactctttattcaatttgccagtccatgtcttttacttggggcatttagcccatttacatttaaggttaatattgttaagtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttgatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatacgaggatcctttcgatggtaattttggaagatcctatttgaaatagtgatcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtgtttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttattttttttttttattatactttaagttttagggtgcatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatagattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgagaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattagagtcctattcttgatttaggttcaacatttattccgagctatttatgttaccctatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagagcaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggaagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaactaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagtaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctttatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaagacctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattataattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttctttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcccgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccacttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttgtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtattataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaggtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtattttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattaataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaatttttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgagtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattgtgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaaaaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctcccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagatattttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaaattttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagatgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgatacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctccctctctctctctctctatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattcaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagcgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctccgagacaaaacttccagaggaacgatcagacagcagcgttcacggttcacgaaaatctgctgttctgcagccaccgctgctggtacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagtttagagaacaaagaataaaaagaaacaaacaaagcctccaagaaatatgggactatgtgaaaagaccaaatctatgtctgactggtatacctgaaagtgagggggagaatggaaccaagatggaaaacactctgtaggatattatccaggagaacttccccaatctagcaaggcaggccaacattcagattcaggaaatacagagaacgccacaaagatactcctcgagaagagcaactccaagactcataactgtcagattcaccaaagttgaaatgaaggaaaaaaatgttaagggcagccagagagaaagattgggttaccacaaagggaagcccatcagactaacagcggatctctcagcagaaactctacaagccagaagagagtgggggccaatattcaacattcttaaagaaaagaattttcaacccagaatttcatatccagccaaactaagcttcataagtaaaggagaaataaaatactttacagacaagcaaatgctgagagattttgtcaccaccaggcctgccctaaaagagctcctgaaggaagcactaaacatggaaaggaacaactggtaccagccactgcaaaatcatgccaaattgtaaagaccatcgaggctaggaagaaactgcatcaactaatgagcaaaataactagctaacatcataatgacaggatcaaattcacacataacaatattaactttaaatgtaaatggactaaatgctccaattaaaagatacagactggcaaattggataaagagtcaagacccatcagtgtgctgtattcaggaaacccatctcatgtgcagagacacacataggctcaaaataaaaggatggaggaagatctaccaagcaaatgaaaaacaaaaaaaggcaggggttgcaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtaacctacaaagagacttagactcccacacaataataatgggggactttaacaccccactgtcaacattagacagatcaatgagacagaaagttaacaaggatacccaggaattgaactcagctctgcaccaagcggacctaatagacatctacagaactctccaccccaaatcaacagaatatacatttttttcagcaccagaccactcctattccaaaattgaccatatagttggaagtaaagctctcctcagcaaatgtaaaagatcagaaattatggcaaactgtctctcagaccacagtgcaatcaaactggaactcaggattaagacactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaagagagaagaatcaaatagacgcaataaaaaatgataaaggggatatcaccaccgatcccacagaaatacaaactgccatcagagaatagtacaaacagctctaagcaaataaactagaaaatctagaagaaatggatacattcctcgacacatacaccctcccaagactaaaccaggaagaagttgactctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggattcctccccaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttcgggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctgaggacacaaaatcaatgtacagaaatcacaagcattcttatacaccaataacagacaaacacagagccaaatcatgagtgaactcccattcacaattgctacaaagaggataaaatacctagcaatccaacttacaagggatgtgaaggacctcttcaaggagaactacaaaccactgctcaatgaaataaaagaggatacaaacaaatggaagaacattccatgctcatgggtaggaagaatcagtatgaaaatggccttactgcccaaggtaatttatagattcaatgccatccccatcaagctaccaatgactttcttcccagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataacgctgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaa

SEQ ID NO: 285 - DNA, 42247 bp, Homo sapiens
  source 1..42247: mol_type = genomic DNA
gcttaacatcctacaaaatgatttaaaattattgttatatgcatttatcttcactctgatgagggctcagacttgataacacccgtggtgccccatccctataggagctggtgagattgcagcctgctgcctcccctccaacagccacagctattggatttcccacccagaatctttaggtaaatgaggtaagtcctgatttttaaaacttcttttgaatctggaatccaaacacttgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcattgtctggacttctaatctctgtgaatttaaaagccccctcgtttccctatgcctgggtggcaaaaccattcccctgggttgaattcttctggaacaaataggcagctagagataggtggctctgatatagctcagagaagaagtggttggctaagtagctgttagggctcagagtacacggtctcgctttctagagatgtcttctgctggtaatttttctgacttatgagctacatggaaaggccaatttgtttttaatatgttccaggactggaaaatggctagaaataggcaagaacatacacaatcacactggaaaaagtggccaggcagccaaggcaggcagaggtattggggagagctgaatatctacaaaaacaaaaattcagaaaaaacaaaaatcaattttggcaaagggcttcactgtataacaaggggacaagctaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagctgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatacttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttaccatgtcagccaggctggttttgaactcctgacctcaggtgatccacctgcctcagcctcccaaagtgctgggattataggcttcagccaccgtgcccagccatattgttttcatttttaatctattagtctatcgtgatctcccagtggaagtatctttggcctttgtggacgtcaggaaagccctacattcccactcgcgattccatgtttatgggtaccctaaatgctcccattaattgaccaactttaccctgatcttctttcaatatctttctgactccttgaaggtatgagacaaaatggaaactgagaggttaaaaggtttactaggttgcattcaattagcgaattggaaactggaaggagctcctatcgggtctcaggtcagaacgtgagtgcttttggccaaagttcacttctgaggaagtagaatttcgctttctggaatcttgcgatattttatttcctctatatctttcccatgcccccgacccacccaatctccacaaatttggggatttgagcactgggttgtgatcgttagaccatcttgcttttctgaaagcccagggcaagacccctgcttcatgtcacagtatcaaacacagacatagaagcttgtacaaattattgagaagttattgtcttttctcccttcctccatatggagtcatctctatgccctttcatacagatgtgatttacgaagacctctgggttaggggtggggtggtgagcaagaatcccgtggcagaatctgctaacacacttgagaagcaatgttgtggttttaaggaactcaatctaaagcttgaacctgattttcagggataccattttgctgccgtttcagcccatttctcttgttaagatcgctctctggtagagttgacgtgacactcatttctgttgtgggtggggccctggttgggaggcattggctccactgcagcctgggtgtctagagaccacattctcaccctgcctttgttactgggaaaccgaacgcggcgctgtggctttcagcttgggtaagccgggtctgcggcggggattgccatctgaagacagaggcaggagggcagccacaccttgcccaggttctcttaaatctcttgctctataactgaaaggagggcatagataattaactttatttgacatttttcatatctaatttttaagaatatgattttaaaataatagatttgttctaaagagcaaacaatcttgctgttattaaaaacgtgtttacttaaattgaacggggtttcaaagggccaagctactaagctgtgcaggaaacaaacagtgcagtgaggagaatggctcctcaccacagctattcttagggtgggacatagtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctggacggcagtctagggacctggtctagcactggcagagctgtgtgtcccagagcacacattcccctttgccaggctttagtttcctcctctaggcaaaagggtttgaacctgaccatctttaagatccattttaaccctcagattctgtggctgtggtgattgggggtggtgggagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagggaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaagcagggtggcccatttaaagaggctcctagggttttaattgaccttgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaagccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagtagggctgatgatatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatgaggtttctggtcatgcaaatgtggtttctagagcctatttgaattgaacaagtagttcttattattagtaaaacagcaaggatccctaacttggggtccaagggtaaattcagggtttctgtgaacttggatgtaaaaaaaaattgtctttattttcaataatctctaactagaatttaacattttctttcaatatgaatgtaggcaaaactccatggtagtattagctgcaattgtgactatcaccaggataaatcacattttcatgtcttattacacctattacatatatcacaaaaagtgggtatttgatatcaagttagatctgcactaggtagatattcttatttaatgtattaacaaggaagcacatatattgttatcaggttggtgcaaaagtaattgtggttcttgccattaaaaataattacaaaaacagccagtctggccaacatggcgaaaccccatctctactaaaaatacaggtgtggtagcacacacctgtaatcccagctacttgggaggctgaggcaggagaatcatttgaacctgggaagcagaggctgcagtgagccaagatcacaccactgcactctagcctgagcaacagagtgagactctgtctcaaaaaaattaaaaaataaaaaaaaactctgtaattacttttgcaccaacataatatgatatcacacatttattttaaaaagtattttgacattgtcttttaatataaatttttttaaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgagtgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggccctgcatgttccttttacactgagctctgcaaatgatgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaagatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaaggaaactttacttcttctaaaggagaggtcgtctaatttgtgagaaaattcagatgttatttgcttcttaagctgcaaggatgctaatgaaataattctcatgaagttctgttggtgttttagggctaagtttttatagactgttccaaaattcaaaacagggatgtggacgtagtgatggtggaagaggggaagacttttcctcgatttctttgcctgagggatggaattcaggctcccccaataacatattcatggtctttctctggtcagtcagtgatgttcataacacaagcaagcctgtcatcaggaccaatctgtgatggctgagacatcaggtgctcttccaaaagagccataattcacccttcatttcccaaggttttttttttcttgctgttattactgctcttttatcatggttaataagtctgaggtggcttcagacagccagtcctaacccctgagtcaatctggggcctctaacaggaagccagactgaagttctgatagatgggtttgagtggctgtgaactgtgtttctgtagcatccagactgatttgcactgaaagggagcttccatattagggtacaaggatgatcaatatgtctcctgtttatatttggtggaaaaagttgtgggaatcgtgcttaaaggatctcaactttgaaattaaaagtataacgtcctaacagacatcctccttctctttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaacactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgcgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccaataggccttactcagaacaagaggagccgtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaactgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggcatctgaatgtaccatcttgtgaatgtaccatcttttaaacgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttcctctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaa

SEQ ID NO: 286 - DNA, 42247 bp, Homo sapiens; identical to SEQ ID NO: 285
  source 1..42247: mol_type = genomic DNA

SEQ ID NO: 287 - DNA, 30824 bp, Homo sapiens
  source 1..30824: mol_type = genomic DNA
aacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgcgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccaataggccttactcagaacaagaggagccgtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaactgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggcatctgaatgtaccatcttgtgaatgtaccatcttttaaacgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttcctctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaa

SEQ ID NO: 288 - DNA, 32872 bp, Homo sapiens
  source 1..32872: mol_type = genomic DNA
agttccagggaaggagggcgtagacaaagcgccacctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggtactggatcccgggctaagctcgggaggaggtcccctttggtggggccatttcgggaaagtatgtcaggacgtaagtgcttcactgaagacaggatctgattttttcctaactggttccctatgtcctgccttctggtgcgttttctttagatcttggactactacgggccaacattagctaacatttatggagcaccgttttaagcacactatatgaatcgattaatccaccaaaatcccaagagctaggtaggatgacaacccccattttattgatggggaaccctaaagagctccggcggtgctgcctgctgcaactcctgcctgatcaatatggttgcagtcagctatagactgttttactgagaccggacaacattagttcagtcgtttgtggtaaacatctacgtgtacaagcacactttataaacatttttttctttctttttttttttttttgagacggagtttcgctcttgttgcccaggctggaatgcaatggcccgatctcagctcactgcattccacctcccgggttcaagcaattctcctgcctcagcctcctgagtagctgggattacaggcatgcgccactgtgaccggctaattttgtatttttagtagagacagggtttctccatgttggtcaggccggtcttgaactcctgacctcgggtgatccgcctgcctcggcctcccaaagtgctgggattacaggcgtgagccaccgcgcccggccaaacatttttttctttcaagacggaggcttgctctgtcgcccaggctggagtgcagtggcgggatgtctgttcactgcaacctccgcttcccaggttcaagcgattctccttcctcagcctcctgagtagctgggattacaggctcccgccatcatcatgccacactaatttttgtgtttttcggagagacggggtttcatcatgttggccaggctgctctcgaactactgacctcaggtgacctcctgcctcagcctcccaaactgctgggattacaggggtgggccaccacacccggcctggctcagcattttgggaggccaaggcgggaggatctcttgagcccaagagttcaagaccagtctaagcaacatagtgagaaacccataccgatctctacaaaaaaaatagaaaaaattagccaggagcggtggtgcatgcctgtagccccagctgcttgggaggctaaggtgggaggattgcttgagcccaggaggttgagactgcaaatgagctgtgatcaagccactgcactgcactccagcctggatgactgagattgaccctgtctcaaaaaaaaaaaaaaaaaaaaaaaaaaaatgtgggacagataaactggaaaatcaagatggcccagagtagacagacaaggctggggaggttgtgtgtgggaatggcagtcgggaaatgctttatagagtgtctgggcctgaaagggtagaaagacttgggaggggaattccagttaaaggaacaactggagcacaagcttggtgctagaaaaagaaggaagtgtgtagctacaattcatgaaagatgggcaaaaggggagtattagaatataaaactggaaagtatttcctggggaaagccagataagcaggaccttgaatgcaaagctaaatcatttgaattatacatagaaaagaaaaaaaaaccggggagagtttttaagtaggaaagtgataagacattgggggataagatggagacaagggcattaattagattgccatagtagtttaggcaagaggattcaatgctaacaagtataatggcagtggaagtggaaaagaggggatttaggttaggggtctccaactcacgtacagaaatcagctaagtaatgtaggtaagtgaaatgaactgagttgggactctggtgaactgggcagccctttcacagctccagctgattgttgccttgcgacaatattgtctctgtgtgatcagatagtcagttttcaaaagaatccagaagtccagaattgtgtatttactcacgttgaaatgttgaatttaaaattttttggccgggcgtggtggctcatgcctgtaatcctagcaccttgggaggccaaagtgggcggatcacctgaggtcaggagttagagtgaaggggtgggttgcccctccacacctgtggatgtttctcctaaggtggaacgagagacttaggaaagaaaaagacagagacaaagtatagagaaagaaataaggggacccggggaaccagcgttcagcatatggaggatcccgccagcctctgagttcccttagtatttattgatcattcgtgggtgtttctcgaagagggggttgtgtcagggccacaagacaatagtggggagagggtcagcagacaaacacgtgaacaaaggtctttgcatcatagacaaggtaaaggattaagtgctgtgcttttagatatgcatacacataaacatctcaatgctttacaaagcagtattgctgcccgcagatcccacctccagccctaaggcggtttttccctatctcagtagatggaacgtacaatcgggttttataccgagacattccattgcccagggacgggcaggagacagatgccttcctcttgtctcaactgcaagaggcatgccttcctcttatactaatcctcctcagcacagacgctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatctcgcaccgcccttaatccattgaaccctgagtttgacacagcacatgtttcagagagcacggggttgggggtaaggtcacagaatctcaaggcagaagaatttttcttagtacataacaaaatggagtctcccatgtctatttctttctacacagacacagtaacaatctgatctctcttgcttttccccacattagagaccagcatggccaacatggtgaaaacccttctctactaaaaattcaaaaataagccgggcgtggtgtgggtgcggtggcaggcgattgtaatcctagctacttaggaggctgaggcaggagaagtggttgaacccgggaggtggaagttgcagtgagccaagatcaccccactgcactccagcctgggggacaagagtgagtctcaaaaacaaacaaaaaaccaaaatatgcccgtgggccaaaggtggcctttgattgtgagtttgcaacctcttgtgagtgacatagaatctactagaaaagagggcattttaaaaaaagtaggctgggtggagcggctcacgcctgtaatcctgaagggggccagcccctccacacctgtgggtatttctcgtcaggtgggacgagagactgagaaaagaaataagacacagagacaaagtatagaggaagaaaagtggacccggggactggcgctcagcatacggaggacccgcaccagcactggtctctgagttccctcagtatttattgatcactatctctaccatctcagccagagggatgtggcaggactatagggtaatggtggggagagggtcagcaggaaaacatgtgagcaaaggactctgtgtcataaataagtttaaggaaaggtgctgtgccttgatgtgcacgtaggccacatttatgattgactttacacaaacatctcagcgcagtaaagagcagtattggccgggcgcggtggctcacgcctgtaatcccagcactttgggaggctgaggtgggtggatcacgaggtcaggagttcgagaccatcctggttaacatggtgaaaccccgtctctactaaaaatacaaaaaaaaaattagccgggtgtgatggcgtgcgcctgtagtcccagctacttgggaggctgaggcaggagaatggtgtgaaacctgggcgacaaggcgagactctgtctcaaaaaaaaaaaaaaagcagtattgccgccagcatgtctaacctccagccataaggcggttttctcctatctcagtaaatagaatgtacaatcgggttttatacagagatattccattcccagggactagcaggagacagatgccttcctcttatctcaactgcaaagaggccttcctctttcactaatccttctcagcacagaccctttatgggtgtctgggggacggtcaggtctttccattcccatgaggccatatctcaggctgtctcagtggagagaaaccttggacgatacccaggctttcttgggcagaggtccctgcggccttccgcagtgcactgtgtccctgggtactcgagactggagaatggcgatgacttttaccaagcatactgcctgcaaacacatttttaacaaagcacatcctgcacagccctaaatccattaaaccttgagtcaatacagtgcatgtttctgcgagcacagggttggggctagggttacagattaacggtgtttcaaggcagaataatttttcttagtacagatcaaaatggagtttcttatgtcttcctttttccacatagacacagtaacagtgtgatctctctttctttcccccacataatcccagcactttgggaggccaaggcaagcagactacttgagcccaggagtttgagaccagcctgggcaacatatggagcccgtctctacaaaaataaaaattagctgcgtgtggtggtgcatgtgtatagtcccagttctgggggaggctgaggtggggaggattgcttgagcccaggagttcaaggctgcagtgagctttaattgtgcaacaaatagaggccctgtctcaaaaaaaaaagagggtttcactcttggtcactgtaacctcaaactcctgcacacaagcaatcctctgggctgagctgggactacaggcatgggccaccgtgcccagctaatctattttgctttttgaatagacagaggtcttgctgtgttgcccaggctggtctcaaactcctgggctcaagtgattctccagccttggcctcccaaagcaatccctaggtaacagactcagtctggcttcctggctctggcttcttcccttctagttcattctccacactgtagtcagagtgatctttacgaataaaaactctggtcggtcgggcacagtggctcatgcctgtaattccagcacgttgggaggcctaggcgtgtggatcacttgaggttgggagttcgagaccagcctgaccaacatggagaaaccccatctctactaaaaatacaaaatcagccaggcgtggtggcatatgcctgtaattcgagctactcaggaggctgaggcaggagagtcgcttgagaaaggcggaggatgcggtgagctgagatcgtgccactgcactccagcctggccaacaagagcaaaacctctctcaaaaaaaaaaaaaaaaaaaaaaagtctggtcaggtcccacttcagctcacaatcagttcagtgcctctccattgtctttaagctatagcccaaattgatcaatacagccattaagaagtgctgctaggccaggcgcggtggcttacctgtaatcccagcactttgggaggccaaggcaggcggattacctgaggtcaggagttcaagaccagcctgggcaacatggtgaaatcccgtctctactaaaaatacaaaaattagctggacatgttggagtgtgcctgtaatcccagctactcgggaggctgaggcataagaattgcttgaacctgggaggtggaggcaacgatgagctcatcgcaacgatgagctgagatcacgccattgcactccagcctgggcgacagagtgagactctgtctcaaaaaaaaaaaaaaaaaaaaaaaagccctgcttctaacagggccaatggctcacacctgtaatcccagcactttgggaggcgaaggtgagagggtcccttgaggccagaggtttgagaccagcctgggcaacatagtaagatgaaacccccatctctacaggaaaaaagcccttcctccctatcgccacccctcccccaagcctaaactaccccttctcacccacagtcaactccctggggtttgattttatctaggtaaatcatcctgctatctctattgtctagcagaatacaattcacaaataggactcaatatacatttattagttacctctataagtttttttcagtttgcctctttatgttgggaatgctgtaaatttttaaatgatcttttctcagccaattcattgactgtcctaccttaccaaatgattttgctcttagagaggtctggagagtgtttgttcaaggagcaaccctgcccccacctggcagcaagaggcactgcctcaattaatagaggagaaggatatgcaaatgaccagtgcttgtcagggaactggcagagacgtgacagtggagaaaaggctcaaattctttttgagatggggtctcattctgtcacccaggctggagtgcagtggcgtgatctcagttcactgcaacctctgcctcccaggttcaagcgattctcttgcctcagcctcctgagtagctgggattacaggcgctgcaaccactcccagctgatttttatgtttttagtagagacggggtttcaccatgttggccaggctagtctcgaacccctgaccttaagtgatcagcctggcttagcctcctaaagtgctgggattacaggcgtgagccaccactctgggcctcaatttcttttctttttgaaccaggatctcactctgtcacctaggctggaatgcagtgtgtgatcacggctcactgcagtgttgaactcctgggctcagaggatcctcccacctcagcctcctgagtaactgggactgtaggcatgtgccatcacacccagctaattctttaattttttggagtgtgacagtgcctcactatggtgcctaggcgggtctccaactcctgggctcaagcgaccaaattgctgggaaacaggcatgagccactatacctggcccaacataaatagaatttcctgggttgtggaggagtgtgacattgaggtggtcttccagggaagaggtgcttttacaactgcagtgggtaacatgggtatctgggctacctgctcatgcaatgtactaatgttttctggttctgctttcagcttcatcatgaatataccatttccatctttatatctgactaaagggtctgtctgactttatgacttgataggtctgacaagacccaattcataatggggcagttctggatgcttcatagtcaagctttccagtaacagccctgatgctgtttctcaaaaggcacctacttccctgctttggacagcttggccttgctccagaatctcagggacttgcattgtgcttttgccataggagcttgccataagttctacactgaatctttttttcgctactgatactttgaacccccaggatctgctggattgcatggcttaagtgtgcattgcatcctagacttgatgcagagccctttcctgctcagagtttgagtcaaagttggcagcttagccggtatgtgggctggagatatatttctaagtctggatgtgacagacaccacacccgtgcattctttttgtctttaatggtggcactaatctctgtccctccccaggatgtgatactgcttttgatttactatcatagctgaagagagggaggggttttagagatctctttgtctgtcccactatgataggtcttacctcttaggccaaggacccaatgcgattacttcaactcctaagtatatcaatcctgttaaatacttggttttttttttttttgagatggaatgtgctggcttgcagtggtgccatctgggctcactgcaacttccaccttccgagttcaagcaattcttggtcctcagcctcccaagcagctgaggctataggcgcgcaccagcacgcctggctaattattttttttatttttatttttatttttgagacggagtctcgctctgtcgcccaggctggagtgcagtggcgcgatctcggctcactgcaagctccacctcccgggttcacgccattctcctgcctcagccttgcgagtagctgggattacaggcgcccaccaccaagtctggctaattttttgtatttttagtagagacggggtttcactgtgttagccaggatggtgtcgacctcctgacctcgtgatccgcccgcctcggcctcccaaagtgctgggattacaggtgtgagccaccacgcccggccgctaatttttttttttgttttgagacagagtcccactctgtcgcctaggctggagtgcagtggtgcaatctcggctcactgcaacctccacctcctgggttcaagcaattctcctgcctcagcctcccatgcccagtccccgtttaaacacttggaactgaggaaatatctagtgatgggtccatggacaagcagacttactatgagctagtaagttttggctaggacttcagttactgcctgacacctgtaagtccccactgtaatgtgggaatcatgatgaagctttgggtttccaggtctcaatgtcagctcagatcttgtgcccaaaatcctcaaagtgtttaggcatttccctttacccagtgtaccgttatctgagtaagtgatatgttgacattctcccttttaggaggaactggcagaaccgttacagttttagcatcctttcgtagggatttgtgtacctcttcagtaattgagttttggatgtgaaagttgtttcagccaggtgcggtggctcatgcctgtaatcccagcactttgggaggctaaggcagtcagatcacttgaggtcaggagtttgagaccagcctggccaatgtggcgaaaccccatctctactaaaaatacaaaaattagctgggcatggtggcgtgtgcccgtaatcccagctactagggaggctgaggcaggagagtcccttgaaccctggaggtggaggatgttgcagtgagcctagattgcaccactgcactccagcctgggcaacagagcaagactctgtctcccccacaaaaaaaaaaaaaaaaaaaaaagttggcttagatccaggagctgaatcaaggattttgcctgtttattgtggtgattgcccttagctgcctcttcctcctctattcttgcctttttctgtttgtagatgcttagtagcatcctttttggctatccgcatatttttcccctaaggatgccatgctctattgtatccacaactctgtgaatcaaacgcctcatggctacccctgcaacattgacagttttatggtagttgcatatttctggcttttggcagctaagcaatgctacccagcctctgttacgtgttgggagatacttccccgtatatcttgagtagctcagctctgactgcttctcctgtcatcagctgtggactgctcagaagccaccactgaatttctaagtgatgctgatgtccaccgatgtcaccagtatattcttgatggtcttgtaaatgtgtccttcgggtcctttcttggaacaccattctctggtctcacatagtacagtatagtacgtatatctattccagcatgcccacttttttcagccactttttttttttttttggatggagttttgctcttgtcgcccaggctggagtgcaatggtacgatcttggctcattgcaacctctgcctcctgggttcaagagattcttctgcctcggcctcccaagtagctgggattacaggtgcctgccgccatccccagctaatttttgtatttttagtagagacggggtttcaccatgttggccatgctggtcttgaactcctgacctcaggtgatccatcctgatgggaatgttaattgtggtagtttctttgcttttttttggcaggtgggggggtggtctcactctattgcccaggctggagtgcagtggcacgatcttggctcactgtaaactctatctcctgggtccaagctactctcgtgcctcagcctcccaagtagctgggattacaggtgtgtgccaccaaacctggctaatttttgtatttttaatagagatgggccttcaccatgttggccaggttgattgcaagctcctgacctcaggtgatccgccctccgcagcctcccaaagtgctgagattacaaggtgagccaccgcatctggccctgcttttttggtctgtgagccagaatagtatctgttcttatcctctaacatctcatcagttctgtacttgaggatactttatcagatagatttttggaacagggagattgaataaaaacttaaacttgctcatcctttttacaagtcaatatagtattgcattacctccatgaatgctgtggttctaccttttggggcagatgtcagttaaaattcagactgtcacattccaccgtatcttttggtttctggaaaaaactttaaggtgaatctgctatttcttttttcttctttttctttttctttctgtttttttgagatggagtttcttgttgtgcaggctggagtgcgatggactgatctcggctcgccgcaacctccgcctcccaggttcaagtgattctcctgcctcagcctcctgagtagctgggattacaggcatgcgctaccacgcccagctaattttttgtatttttagtagagatggggtttctccatgttggtcaggctgatcttgaactcctgacctcaggtgttgcgcccacctcggcctcccaaagtgctgggattacaggtgtgagccaccgtgcctggcctatttccctttattctttctcttttcttttcttttttttttttttttttttttgatacagagtctcgctctgtctccaggctggagtgcagtggcccgaccttggctcactgcactctccgcctcccgggttcaagctattctcctgcttcagcctcccgagtagctgggattacaggcgtgcaccatcacacccagctaatttttgtgtttttagtagagacgtggtttcaccatgttggccaggatggtctcgatcccctgaccttttgatctgcctatctctgcctcccaaactgctgggattacaggcgtgagccaccgtgcccggctgcttccctctttctttaaatttaatttaatttttaaaattaagatgtttatctcactatgttgcccaggctggtctcaaactcttggccacaaacaatcctcccacctcagcctttcaaagtgctgggattataggcatgagccaccatgcctgaccccttttttctttaacattatgtttttgacacatttttgcctatcttttatgtcctggttctttcaaatttagtcatttctagtattctagttagaaattttctacaaattattttacaaatgttctacaaattatttttcaaaaaaaattttttttttttgagacagtctcactcttgtcgcccaggctggagtgcaatagcatgatcttggctcactgcaacctcttccacccaggttcaagtgattctcctgcctcagcctcctgagtagctgcgattacagcctcctgccaccatgcccagctaatttttgtatttttagtagagacggggtttcacagtgtggtccaggctggtctcaaactcctgacttcaggtgatctgcctgccttggcctcccaaagtgctaggattacaggtgtgagccaccacgcctggcctatttttcaaatttccaaatttttactactataaccagtgctgcagtgaaatcttttatatattgttttgtgtacatgtgtgagagtttctctagggtatgaatctagctaggactgttggtgggtaaaagggtattttcattcttttttttttttttttttgagatggagtctcactctcttgcccaggctggagtgcagtggcacgatctccactcactgcaacctctgcctcctgggttcacgccattctcctgcctcagcctcctgagtagctgggactacaggcgcccgccaccacgcctggctaattttttgtatttttagtggagacggggtttcaccatgttagccaggatggtgttgatctcctcacctcgtgatctgcccgcctcggcctcccaaagtgctgggattacaggcgtgagccaccgtgcccggccaagggtattttcattctataggcggttgcaaattgctctcctagaacggatgtaccaactaatgttgccacttatgcaatttgtatcctcctaatcacttggtttagtcagatgttttcatattgccaatctgacggacatgaaattctattttcttgccattttaatttgcactttccagattactaatgaggttttgtaatctttaccattcttttgtatatctaattttgtgaattggcttttttgtttttgagacggtctcattctgtcgcccaggctggagtgcagtggtgtgatttcagttcactgcaacttctgcctcccgtgttcaagtgattctcccacctcagcctcccgaatagctgggacgacaggcttgcaccaccacgccccgctaatttttgtatttttagtagagacagggtttcaccatgttggccaggctggtcttgaactcctgacctcaagtgatccacccaccttggcctcccaaagtgctgggattacaggtgtgagacaccacgcctggcctgaattggctatttctattatgtgattagaatagaatttctatttggtgggtgccgtggcttacatctgtaatccctgcactttgggaggccgagatgggcggatcacaaggtcaggagatcgagaccatcctggctaatacggtgaaaccctgtctctactaaaaatacaaaaaattagccaggcgtggtggcgggcgcctgtagtcccagctactctggaggctgaggcaggagaatggcatgaacccaggaggcggaggttgcagtgaggcgagattgcaccactgcactccagcctgggtgatagagcgagactccatctcaaaaaaaaaaaaaaaaaaaaaaagaatagaatttctatttggtgattttttttcttgatgattattggtttttttcgtactggtttttagtgataatttatatgtttcatctactttgttagctatattagtttcagatagtatgtcttctatttgtggcttgtcttttcagtttgttatggcaaattgtgatgcataattttttctcttttaatgttgcacaatttatttgtctttttcttcatgatttattcttttgtgtattttttttttttttgagttggagtcttgctctgtcgcccaggttggagtgcagtggcgcgatctcggctcattgcaacctctgcctcccgggttcaagctattctcctgcctcagcctcttgagtagctgagattacaggtgcctgccaccacgcccagctaatttttgtatttttagtagagacggggtttccccatgttggctaggctgctctctggccaggcttgtctcgaactcctgaccttgtgatctgcccgccctggtctcccaaagtgctgggattacagacgtgagccaccgcacctggcctcttttgtttcttctttaaaactcttttcttatcctgaggtcagaaagatattcttatttttttctgaaattttatttatttacttatttatttatttttttttgagacagagtctcactttgttgccagcctggagtgcagtggcgtgatctcggctcactgcaacctctgcctcccaggttcaagctattctcctgcctcagcctcccaggtagatgggactacaggtgtgcgtcaccacgcccagctaatttttgtatttttagtagagatggggttttttttaccatgttggccaggatggtcttgatctcgtgaccttgtgatccgcccgccttggcttcccaaagtactgggattacaggtgtgagccaccgcgcctggcctatttgattacttagaatataattttgtgattggtgtgaagtagtgatctaattttatttttttatagtaccatttggtaaatagttcattctttccccactgattatattatctctgtcgtatattgtttcaagtatgcatgagttatttttaggctcgttttctgttccgttggacacttgcccatccctgtgtctttagcatactatgattgttactttatacattattattattattatttttttttttttttgtagagttggggtctcactgtgttgcccagactggtctcgaactcttggcctcaggtgatcctcttccctcagcttcccagaatgccgagatgataggtaataataataataataattattattattattattattattattattattattatttgagatggagtcttgctctgttgcccaggctggagtgcactggcgcgatctccacttactgcaagctccgcctcctgggttcaaggttcaggtgtttctcctgcctcagcttcctgagtagctgggactacaggcgcccgccaccacgcctggctaatttttgtatttttagtagagacgagtttcagcatattggccaggctggtcttaaactcctgaccttgtgatccgcctgccttggcctcccaaagtgctgggattacaggcgtgagccattgcgcccggcctgattacaggtaattattcctttagcaaataacatgcctgctgcctggtagggcttatcttttttttttttttttggtgtgaagtcttgctctgttgcccaggctgcagtgcagtggcgtgatcttggctcactgcaacctctgcctcccaggttcaagcaattctcctgcctcagcctcccaaatagctgggatttcaggcacccgccaccatgcctgactaattttttgtatttttagtagagacggagttttgcctcattggccagcctggtctcgaactcctgatctcaggttatccgcccgtctcggcctcccaaagtgctgggattacaggcgtgagccactgtgcccaaccatactttatataatattattattattattatttgtagagacggggtctgactgtgttacccaggctggtcttcaactcttggcctcaagtgatcctcctgccttagcttccaagaatgctgaggttacaggtaattattattttagcaaataacatgcttgctatctggtagaatttgtctttaaaaatacgattttttttctttaaagatatctttactattctctgcccttttctcttgcacatgaattatagagtcatcttacaaagttctcaccaccagatattaagatttgtattagaattgcatttggatttttagattgtttggggagcactaatttctttatgacatcaaatctttattttattattattattattattttttgagatggaatcttgctctgtcgcccaggctggagtgcggtggcgtgatcacagctcactgcaacctccgcctcctgggttcacgccattctcctgcctcagcctcccaagtggctgggactacaggcacacaccgccacgcctggctaaattttttttgtatttttagtagagacggggtttcaccatgttagccaggatggtctcgatctcctgaccttgtgatccgtctgcctggcctcccaaagtgctgggattacaggcgtaagccactgcacctggccctctgcttttttaaaaaaagaattcattagctgagtgcagtggctcacgcctctaatgctagcactttgggaggcagatcacttgaacccgggagttcgagaccagcttggacaacatgacaaaaccctgtctctaccaaaaaatacaaaaattagccaggcatggttgcatgctcctgtaataccagctgttcaggaggctgaggtgggaggattgcttaagctgaggaagtcaaggctgtagtaagccaagatcacattactgcactccagcctgggcaacagagagagaccctgtctcaaaaaaacccaagaaacagaaaacagaatttgtctttagtttctctatagtccagcctccttttaagagacttggtgttgaaattaaccaattttttctttctttgagacggagtttcactcttcttggccaggctagagtgcaatggctcgatctcggctcactgcaacctctgcctccccggttcaagtgattctcctgccttattctcctgagtagctaggattacaggcatgtgccaccacacctggctaattttgtatttttagtagagatggggtttctccatgttggtcaggctggtgtttaactcctgccctcaggtgatccgcccgccttggcctcccaaagtgttgggattacaggcgtgagccactgtgcctggcctaaccaattttttagttgcagaatgagtgatatttcaaattcaattttctgttacagcataccatactctaaatatctacttctcaatattttatattctctttcaccttattgattataaaatatatatatatttttcagacagggtctcgctctgtggccttggctggagtgcagtggtgtgatctcagcttactgcaccctcaacttcccaggctcaagtgatacctcccacctcagcctcccgagtagctgggactacaggcatgtgcaaccacactcagctaatttaaaaaattttttgtggccgggcctggtggctcacgtctgtaatcctagcattttgggaggccaagtcgggcagatcatgaggtcaggagttcgagaacagcctggccaacattagtgaaaccccgtctctactaaaaatacaaaaattagccgggcatggtggtgggcccctgtagtcccaggtactctgggaggctgaggcaggagaatcacttgaacctgggaggcagaggttgcagtgagccgagatcgcaccactgcacaccagccagggtgacagtgcgaaactctgtctcaaaaaaaaaaaaaaattttgtacagacaaggtctcactatattgcccaatctggtcttgaactcctgggatcaagtaatcctcctaccttggccttgcaaagtgctgggagtactaggtgtgagccaccacacccggccagctaattaaaatcaaacttttttttatagagacacggggtcttgctacgtggccctgtctggtctcaaacttctgggctctaatgattctcccattttggcctcccaaattacaggcgtgagccatggcacctggccaggctcatcagttatttgtttttttgtttatttctaatttttattttaattattttagaccagttctagctctgttgcccaggctagagtgcagtggtgcaatcataactcactgtagcttcaacctcctgggctcaagtggtccctcccacctcagcttcccaagtagctgggaccccaggtacttgcaccatgcccagctaatttttttttttttttttttttttttttttttttttttggagaaagagtctcaaataatttatgtagatcttccctctgcccagagatacagagtttaactctgtacatcttgagtgcaggctgcgcttagtgattctcttcctcagagtgtgatgacaaagttttggagggccaggggagggagaaaatgaggatgcagtattgtgtgatcatgactgcagaaatagctgctgttggagggcctcagtgatcattttaaggtctcttattgctacttatcttttttgatgagattaagtattctgtctctgatcagttgaatatctgatgtcattaatccaaggataatatgttaaaagtactaccccatattttccacatactgacctgctatttctctggtgtttatcttttagtatttggtttcatttgagagaatggcttgctgcaatgtttttcatttgtctaacttacttgaatactggatacttttcagatggtgcatttatttctcttctcctaagagatgactttggttctatttctttcactctttctggcttttatccccactttgcattcttcaccctttagtaagacaaccctgacaggtctcttctttagcagccagtgtccctcctataggattcatagtaacaattaatagtattctgacatgggttcttcagatagtagctgcgaagtgaactgctttagttggagtctttttctctgctttaatttcagccacgctttgacttccaaatgctcaattcctcacccatctttcctttttctttttcttttttttttttttggagacagagtcttgctctgtcaccgaggctggagtgcagtgtaatctcagcttactgcaacctccgcctcccaggttgaagggattctcctgcctcagccaagtagctgggattacaggcacccgccatcgtgtgcgactaatttttgtatttttagtagagatggggatttgccatgttggccaagctggtctcgaattcctgacttcaaatgatctgcccgcctcattcttccaaaatgctgggattacaggcatgagccaccacactggcctcatttttcaaatggctaaaatcttcaagatttctggctgattggtattttagaggcagctttgatgttttgtttctgggtctttggaatagagtcttgggctttcgaagatttatggaggctgttggacagagacagtctcctgaagagtttctagctgtcctcccatcttctctctgcctttagaaatccttcttagatgtggccgggcacggtggctcacgcctgtaatcccagcactttgggaggccgaggcgagtggatcacgagatcaggagatcaagaccatcctggctaacatggtgaaaccccgtctctactaaaaatacacaaaaaaatcaaaattagctgggcgtggtggtgggcacctggagtccgcaggagaatagtgtgaaccttggaaggcagagcttgtagtgagctgagatcgcaccactgtactccagcctgggcgacagagcgagacttcatctcaaaaaaaaaagtccttcttagatgtttttagttgtttgtttatttttcgagatggagttttgctcttgttgcccaggctgaagtgcaatggcacgatctgggcccattgcaacctctgcctcccaggttcaagcgattctcctgcctcagcctcctgagtagctgggattacaggcagccaccaccatgcccagctcatttttgtatttttagtagagatggggtttcaccacgttggccaggctggtctcaaactcctgacctcaggtgatccgcccgcctcagcctctcaaagtgctgggattgcaggcatgagccactgcgcccagcctgtttgtttgttttcagatagggtcaccctgtcagccaggctggaatgcaatggtgtgattgtgatcacagctcactgctgcctcaacctgagggctcaagtgatcctcccacttcagcctccttagtaactgggaccacaggggtgagccaccatgcctggctaatttgttaatttttgtagagatggggtctccctatgttgccgaggctggtctcaaactactgggcttaagtgatcctcctgccttagcttcccagagcgctgggattaaaggcatgagctgctgtgcctggtcaatcctttttacatgtttgaggaaaaataaatgtcctgttttcaggctaagatcaagtaataatcctcatgtgttaggaagcatgtgacatggatttttgcagcagagggttagaaaggaactttctttatatacttggccccctgcatttcagggctccaccgccatctgtctgtctgagtgtaaagtggaccttattggcatctgggctgccaaactgctttttttcctttgctttgcccagccttctcttgaaggctaaattcttgaaaaattatattctttgtgttcctatagtaaatattaagctttatatcaacacatatggcaggatctgaggctctttactcacctctggtccatttctctagtcttttctctgtagtctttttgttttcctgtcctccatctcctaatttattagttttattattatattttatattatttttttgagacagagttttgctcttgttgcccaggctggagtgcaatggcgcgatcttggctcactgcaatccctgcctcatgggttcaagtgatttgtctgccacagcctcctgagtagctgaaattacaggcacgcaccaccatacctggctaatttttgtatttttagtagaaacggggtttcaccatgttagccaggctgatattgaattcctgacctcaattgatccgactgcctcggcctccggaagtgctgggattacaggtgagccacagtgcctggcagtttgttttattttggttgaacagttacaagtcttggtttgttttcctgcagcaacaggtttatcttgatatgatacagcgttatttaaattccttttcattttcctgcctttgtcttcacatgctagtttttttcagttgtttcttttttcttcttccttttctttttttttttttttgagagatagtcttgctgtgttgtccaggttgcagtacagtggtgcgatctgggctcactgcaacctctgcctcctgggttcaagtgattctctcacctcagcctccggagtagctgggattacaggtgcccaccaccacgcctggctaatttttgtatttttagtagagacagcgtttcaccatgttggccaggctggtcttgaactcctgacctcaattgatctgcctgccttggtctcccaaagtgctgattacaggtgtgatccaccgtgcctagcctgtttagttgtttctaagaagggagatattggttttgattgacatagttcatccacttatttaccaaacacttgcgaagtgcctactatatgctgcctccgaataggcaggttcgtccacaatagcacaaggctcctgccacttgtcttcaaggacaaagagacatccagacaaacaaatgtaataaacaaatgggacatgattgtagcagaggcagatgcatggtggagggaaagtaattttgtctggggagttgagaaaagctgtcacttgagctagatcttgaatgaataggaactcatgaggttgagtggacaaacaggaagggccaacagcagaggtatggcatgtacaagatgcagagctctgcctgaaaaagcctggtgtgttgtgagtctggcaggtgtttgaaggctgatgtggctggaggctagtgcctgtgaagcaggtggtggctgataagattggagaggcaagctgttatcctctttatgcatgcagaaggaattgacttcaggctgggcacagtggctcatgcctgtaatcccagcactttgggaggctgaggcgggcagatcacctgaagttaggagttcaagaccagcctggccaacatggtgaaaccctgtctctcctaaaaatacaaaattagccgggtgtggcggtgcacgcctcctataatctcaactactggggaggctcaggaagaagaatcgcttgaacctgagaggcacaggttgcagtgagctgagatcgcgccactgcactccatgctgggtgacagtgtgagaccctgtctcaaaaaaaaaaaaacaaaaaacaaaaggaattgacttcagccatttggagccatgaggatctgtgagtgagatactgtgtcatgttggaccatctcaaagacagcttctgaccccacagttctcaaccttgttcttacttatttttagagacagggtctcgctctgtctcctaggctggtatgcagtggtgccaccatggctcactgcagcctcacaaactcctggactcaagtgatcctcctgcttttgcttcccttgagtgttggcatctcatgggactccaggggcacatcaccaattacagatgataattttttttttttttgagacggagtcttgctctgtatcccaggctggagtgcagtggcgcgattttggctcactgcaagctccgcctcccaggttcacgtcattctcctgcctcagcctcctaagtagctgggactacaggcacccgccaccacgcctggctgattttttttttttttttttgcatttttagtagagacggggtttcactgtgttagccaggatggtctcggtctcctgacctcttgatccacctgcctcggcctcccaaagtgctggtattacaggtgtgagacaccacgcctggcctttttttttcttttttgagacagagtctcactctgtcacccaggctggagtgcagccgcgcaatcttggctcactgcaacctctgcctctcgggttcaagcgattctcatgcctcacccctccaagtctgggactacaggcgtgtgctactatgtccagttaatttttgtatttttagtagagatggggtttcaccatgttggccaggctggtcacgaactcctgacctcaagttatccgccaccctcagcctcccaaagtgctgggattacaggtgtcagccaccacacctggcctgttagtttttttgaggcagagtcttgctctatcacccagactggagtgcagtggcccattcttggctcactgcaacctctacctcctgggttcaagcgattctcatgccacagcatgagaagtgggattacagggattagtaggtgggattacaggtgtgagccaccacacccagccaggcccagataattttaaaatttatttttttatttatttagaaatggagtctcactatgttgccccgtctggtcttaaactcctggcctcaaggaatcctccctccttggcctcctaaagggctaggtgacaggcatgagtcacactgcgcccagccttgagcttttgtgctcgagatatagtccattcagaacctctggttggcacttcttatctggcacatgcagggcaccttggatctcttattatctttgagcactggtctgaacccacttgcttgccttctcccaggggctgccccgtgcaccccttgttcctagggtggggatggggttggatgcctggggttgcagaggggactagcagagggtgacccttttctctatgctattacttcagatcttggcttttgctttcttccaaatacacagcaatcttggcttccagcctaggtgggaaagggagaaagaaccgatttcctccagctcctctctgaaagtagcccaactggcactgtttaggaacaaggagttcctgagagtgttggcaccccacggtgttgatgtccggtagttccctgctgtgaaccctgtctctgccccacttcaatccaaggaccctgtggagggaattctaggcttcttcaaagcctctgcagtaccagctgcctccaaggcctaacatagtgaagtgatagggagacaggaccttgggggagtttggggataactgtgggagttcctgcaaggtgggtaagagtctggccatggcatcttctggtctattccacaaaaaaggtggatgcctctgagacctagctctgttatgttcattacagccctatcagtctcttctggatgtctgattcctagctgccaaacatccaggtgctagcagctgggggtggggtaggataagaaggggggtgtctacctcaaccttcctgcccaaaccattcattttaaagtactgtgaagaaggctggattagtgttaaattcaataaagttaacaaagcaaagtattgtagtgagtacacaataaatagttgctgcatgaggaatttcttgaaatgaattcaagatgagtcttgaaaaacgagtgggagtaagccgtgcacggaagcagaggtctagcagaggtctagcgccaagtcccagaggcctgagagggcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 289 - DNA, 32872 bp, Homo sapiens; identical to SEQ ID NO: 288
  source 1..32872: mol_type = genomic DNA

SEQ ID NO: 290 - DNA, 32872 bp, Homo sapiens; identical to SEQ ID NO: 288
  source 1..32872: mol_type = genomic DNA

SEQ ID NO: 291 - DNA, 8012 bp, Homo sapiens
  source 1..8012: mol_type = genomic DNA
cagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 292 - DNA, 7185 bp, Homo sapiens
  source 1..7185: mol_type = genomic DNA
agttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 293 - DNA, 70861 bp, Homo sapiens
  source 1..70861: mol_type = genomic DNA
ttcctgagaggttgcctttacttatatgcacagtcactcctttagcagaaaatattatggaggtgttaggatgagataaacctgacagcaaccagttccaagaccacacacagcagttttccccttgcctagccccttgagatgcattcttgatagcgagagcacaatggttcccctgagagcctccgtggcccttctgtgtgcctttatcaaccactccccaccatcaccacccttaggcagagagaggaagaagcaggggagatgtggctaattcttctttggaaacacagaaggctatgtcagatgcaatggaatatattgtgacataggattatttggagtattcagccatggggatctcttagaggtctcttatttaaggataggggacctctatggagggcatggttggcttatccaccttcagggtgggcaatgtagtttgaaaggtagcctcacttgtagcctgcctggtgggtgcttgggtgagttcaaagaccacggtgggcatcggtggttgaatctcatgcttgccaggcttcaaaggtgtgacagcattcttgataggtagtagtttcttggatggtgctgcaaaattgaaatggccttggtgttcctttccactcttgggtagagccgggtagagggctgctagagtccaaggaccttccacaactcggacaggaggtttcatggctatgtgcaaatctatctatctatctatcttcctcattcttacttccactctgagtatctgtgggatggaaaagacacagattcctcaaatgtcacttctccactctctgtcagtcatgtgtgaaattcaagttatctcttaaatgttagccactcccttaccctttcaggttctttcctccaagctctcccctctacctcaggctttgtgcaaactttattatggccctccaattcagcctggggctggggcttaagagtctactactgcatgaggctctagctcaccatggaagtcctcagaaagcagagactgacatttgcttaaagttcatgtattccatagccattaaattagtttagaaaaatgagggcttccctcaattaaaatgagggctttttaaagggcagagactttgtcttgtttgccactacatatacagtgctcagaagtgtttgtcacacagtaaatgctcaataaacaatttctgtccaacagaaaaaaaaattagatggtagatacttctaataatggagctaggagatcaagaccaatccttctaccaaagacaaattaaaaactggatgatatacaaaaacaagaaaacatcttaaaattatctatgcgtttacaatatacagagaaattgcatggccaaaatctagaagagtgtgagaatctaaagcccagaactcaggttttgttttctgcttagatttaccttttatttttattaattaatttttaaaagttttttagttgttataaatattcaaagctttttttttaacctgagtgtaattcgatctggaagaaacagctacaaacatgagcttccatttttttttttgtcagctttataggagaaagggaatttttattggatttgaatggaatttttagatcaattccatgacaatatctttataacttttctaattcatgaacatgattgctccatttatttgggcattctttctctcactaaagttttgtagtttttagtgatcaatcatatgccttcccttgtgaaggcttttttgattaaagtctattttttctgatatatttttctgatctaagggatatataccagaggctgtgaatctttggggttatcataggatagttaccgctcttttattattatactttaagttctagggtacatgtgcacaatgtgcaggtttgttacatatgtatacatgtgccatgttggtttgctgcacccatcaactcgtcatttacattaggtatttctcctaatgctatccctcccccatacccccaccccacgacaggctgtggtgtgtgatgttccctgccctgtatgcaagtgttctcattgttcaattccctcctatgagtgagaacatgcggtgtttggttttctgtccttgtgatggtttgctcagaatgacggtttccagcttcatccatgtccctacaaaggacatgaactcatccttttttgtggctgcataatattccatggtgtatatgtgctacattttcttaatccagtctatcactgatggacatttgggttggttccaagtctttgctattgtgaatagtgccgcaataaacaatacgtgtgcatgtgtctttatggtaacatgatttataatcctttgggtatatacccagtaatgggatcactgggtcaaatggtatttctagttctagatcctcgaggaatcgccacactgtcttccacaatggttgaactagtttacactcctaccaacagtgtaaaagtgttcctatttctccacatcctctccagcacctgttgtttcctgactttttaatgattgccattctaactggtgtgagatggtatctcattgtggttttgttttgcatttctcacatgatcagtgacgatgagcattttttcatgtgtctgttggctgcataaaggtcttcttttgagaagtgtctgttcatatcctttgcccactttctgatggggttgttcttgtaaatttgtttaagttctttgtagattccaggtattagccctttgttagatgggtagattgcaaaaattttctcccattctgtaggttacctgttcactccgatggcagtttgttttgctgtgcagaagctctttaattagatcccatttgtctattttggcttttgttgccattgcttttggtgttttagtcatgaagtccttgcccatgcctatgtcctgaatggtattgcctaggttttcttctagggtttttatggttttaggtctaacatttaagcctttactccatcttgaattaatttttgtataaggagtaaggaagagatccagtttcagctttctacatatggctagccagttttcccagcaccatttattaaatagggaatcctttccccatttcttgtttttgtcaggtttgtcaaagatcagatggttatagatgtgtggtgttatattctgagggctctgttctgttccattggtctatatctctgttttggtaccagtaccatgctgttttggttactgtagccttgtagtatagtttgaagtcaggtagcttgatgcctccagctttgttctttttgcttaggattgtcttggcaatgccttgtaagttggattcctaggtattttattctctttggagcaactgtgaatgggagttcactcatgatttggctgtttgtctgttattggtgtataggaatgcttgtgagttttgcacattgattttgtatcctgagattttgctgaagttgcttatcagcttaaggagattttgggctgagactatggggtgattttgtatcctgagactttgcagaagttgctgatcagcttaaggagactttgggctgagacgatggggttttctaaatatacaatcatgtcatctgcaaacagggacaatttgacttcctctcttcctaattgaataccctttatttctttctcttgcctgattgccctggccagaacttccaacactatgttgaataggagtggtgagaaagggcatccctgtcttgtgccagttttcaaagggaatgcttccagtttttacccattcagtatattggctgttggtttgtcataaatagctcttattattttgagatatgtcccatcaatagctagtttattgagagtttttagcatgaagggctgttgaatgttgtcaaaggccttttctgcatctattgagataatcacgtggtttttgtcattgattctgtttatgtgatggattacatttattgatttgcatatgttgaaccagccttgcatcccagggatgaagccaacttgatcttggtagattagctttttgatgtgctgctggattcggtttgccagtattttattgaggattttcacatcaatgttcatcagggatattggtctaaaattctctttttttgttgtgtctctgccaggctttggtatcaggatgatgctggcctcataaaatgagtgagggaggattccctctttttctattgattggaatagtttcagaagaaatagtaccagctcctctttgtatctctggtagaattcagctgtgaatccgtctggtcctggactttttttggttggtaggctcttaattattgcctcaatttcagaccctgttattggtctattcagggattcaacttctgaattcgggtgggtaacccgacctttctcactttagttttgggagggtgatctttgctggtttagtcgtgggagggtgtccaggaatttatccatttcttctagattttctagtttatttgcgtggagagtttatagtattctctgatggtagtttgtatttctgtgggatcagtggtgatatcccctttagcatttttttattgcatctaattgattcttctctattattcttgctagtggtctatcaattttatcttttcaaaaaaccagctcctggattgatttttttgaagggtttttttgtgtctctatctccttcagttctgctctgatcttagttatttcttgccttctgctattaaatttgtttgctcttgcttctctagtgcttttaattgtgatgttacagtgtcaattttagatctttcctgctttcccttgtgggcacctagtgcgataaatttccctctacacactgctttacatgtgtcccagagattctggtatgttatgtcttttttctcattggtttcaaagaccatctttatttctgccttcatttcgttatgtacccagtagtcattcaggagcaggttgttcagtttccatgtagttgagaggttttgagtgagtttcttaatcctgagatctaatttgattgcactgtggtctgagagacagtttgttgtgatttctgttcttttacatttgctgaggagtgctttacttccaactatgtggtcagttttggaatgagtgcaatgtggtgctgagaagaatgtatattctgttgatttggggtggacagttctgtagctgtctattaggtccgctgggtgcagagctgagtttaagtcctggatatccttgttaaccttctgtctcgttgatctgtctaatattgacagtggggtgttaaagtctcccattattattgtgttggagtctaagtctctttgtaggtcactaaggacttgctttatgaatctgggtgctcctgtattgggtgcatatatatttaggatagttagctcttgttgaattgatccctttaccattatgtaatggccttgtctcttttgatctttgttggtttaaagtctgttttatcagagactaggattgcaacccctgcttttttgctttccatttgcttggtagatcttcctccctccctttattttgagcctatgtgtgtgtctgcacttgagatggggctcctgaatacagcacactgatgggtcttgactctatccaatttgccagtctgtgtcttttaattggggcatttagcccatttacatttaaggttaatattcttatctgtgaatttaatgctgtcattatgatgttagctggttattttgcttgttagttgatgcagtttcttcctagctttgacggtctttacagtttggcatgtttttgcagtggctggtactggttgttcctttccatgtttagtgcttccttcaggagctcttttagggcaggcctggtggtgacaaaatctctcagcatttgcttgtctgtaaaggatgtgatttatttctctttcacttatgaagcttagtttggctggatatgaaattctgggttgaaaattcttttcttttctttaagaatgttgaatattggcccccactctcttctggcttgtaaagtttctgctgagagatccgctgttagtctgatgggcttccctttgtgggtaacccgacctttctctctggctgcccttaacattttttccttcatttcaacctttgtgaatctgacaattatgtgtcctggggttgctcttcttgaggagtacctttgtggtggtctctgtatttcctgaatttgaatgttggcctgccttgctaggttggggatgttctcctggataatatcctgaagagtgttttctaacttggttccattctccccgtcactttcaggtacaccaatcaaatgtagatttggtcttttcacgtagtcccatatttcttggaggctttgttcatttctttttactctacttctcttctcacttcatttcattaatttgatcttcaatcactgataccctttcttccacttgatcaaatcagctactgaagcttgtgcatgtgtcacgtagttctcatgccatggttttcagctccatcaggtcatttaaggtcttctctacactgtttattctagttagccattcgtcttttttgaaggtttttagcttccttgcaatgggttcgaacatcctcctttcgcttggagaagtttgttattaccgaccttctgaagcctacttctgtcagcttgtcaaagtcattctccatccagctttgttctgttgctggcaaggagctgcaatcctttggaggagaagaggcagtctggtttctccccatctttgtggttttatctacccttggtctttgatgatggtgatctacagatggggttttggttatggatgtcctttctgttgatgctattcctttctgtttgttagttttccttctaacaaacagtcaggtccctcagctgcaggtctattgggggagtttgctggaggtccactccagaccctgtttgcctgggtatcaccagcagaggctgcagaacagcaaatattgctgcctgattcttactctggaagctttgtctcagaggggcacctggctgtatgacctgtcagtcggcctctactgggcggtgtctcccagttaggatacacgggggtcagggacccacttgaggaagcagtctgtctgttctcagagctcaaacactgtgctgagagaaccactactctcttcagagctgtcagacagggacgttttagtctgcagaagtttctgctgccttttgttcagctatgccctgcccccagaggtggagtctacagaggcaggggcctccttgagctccggtgggctccacctaatttgagcgtcctggctgctttgtttacctactcaagcctcagcaatggcagacacccctcccctagccaggctgtggccttgcagttccatctggactgctgcgctagtggtgagcaaggctctgtgggcgtgggacctgctgaaccaggcagggatataatctcctggcatgctgtttgctaagaccgttggaaaagtgcagtattaaggctggcgtgtctcgattttcctggtacagtctgtcacggcttcccttgactaagaaagggaaatcccccgaccccttgcatttcccaggtgaggtgatgtcctgccctgcttctgcttgccctccctgggctgcacccactgtccaaccagtcccagtgagatgaaccaggtacctcagttggaaatgcagaaatcacccgtcttctgcgtcaatcacgctgggagctgcagaccggagctgtttctattcagtcatcttggaacagacctcaggatagttacctctcttgattaggttatgctatatgacaaaggttctgggataattactccaatgatttacattacattacattacatagacttcatcatagattacacagacttcatcatagcagactggagagatattctgttgttggctttgaagaagtaagctgccatgttgtgaggaccatgtggataggacttgagggtcacctctaggagctcagaccaaaaccctgctaacagccattgagaaaacagagatgacttcacttctacaactatgaggaacttttaattctgctaacaagcagtgagcctggaagaggaccacaaacctcaaataagattgtagccccaattgataccctgtaaagagtaagtaaaggaactgtctaacccatgtctgtgagataatacatttgtatagtgttaagctgctaggtttggagtaattttttaaaatacggcaataaaaaactaatataggctgggcagggtagctcacatctgtaattccagtgctttaggaggccaaggcaagccgactgcttgaggtcaggagtttgagatcagcctgggcaacatagtgagatgccatctctacctttttttttttttaattagccagtcataatggtttgtgcctgtggtcccagatactagggaggctaaggcaggaggattgtttgagcccaggagttcaaggttgcagtgaaccatgatcatgccactatactccagacttgggcgaaagagtgagaccttgcctctaaacaagcaaaacaaaaaactagtaaacacagcaatagaatctatccaaaaataaaggaaattaattaaatattttaaatgactactcagaagactgaggcaggagaatcgcttgaaactgggaggtggaggctgcagtgagctgagatcatgccactgcactccagcctgggcaacagagcaagactctgtctcaaaaaaaaaaaaaaagtctcagtaacctatgggataatatactaacaaacagctgtgtaactggaatcccagaaagcagtggtggagcagaggcagaaaaatatttgaagaaataaagactaaaattatgtccaatttgatgaaaattatactctgacagatctaagaatttcagcaaaccctaatcaagatagtctctctctccctctcacatgcacgcacacgcacgaagttaagccataatcaaactactaaaaaccaataataaaaggaataatcttaaaatgtagccagaggaaaaaagacacgttacaaacagaagaacaggggtaagaaaactgaaactttacataagaaactacatacgacagaagacaacaaaattgacttaaattgctgaaaaataccccctcacactagagagaggccttctggtggtagacatggcatcagtaggtgcagcagtacgtgcccatcctggaggtggcatggggcaacacatggcactccgtatttagcaaatgaggctccattctcctcaactttaatggatctgggctgtggttatggctgaggtcctgacttctgtctagtcttccttgttccttccctgattctaaacttggtcctgcaccttctagatatctctttgaggtacccaaatagctttccaatgccttttctttctgcttagatcaagaaaaactggtttctctaataggcaacctaagagctcttaaaaacagaaaatccttcatttattttctactcaccttttctcatcaccattttagcatagtagtgggtagggtcaagttaactgttactttttctaagccacctcttttatctaggtttatatagttcttcaattttactttcaaaacttctttcccagccatgtttcctcctcatctccatgttctatcactgcttggctggattattgttatgggctgaattatgtccccccaactccaatttcatatgtcagagtcctaaccctcagtgtgactgtatttggagacagggcacttcaggagtaattaaggttaaatgaagccataagggtggggccctaatccaacaggactggtgcccttatgagaagaggaagagagacccgagatcccactctcccaagcacacacacagaaaaggccatgtgaacacacagtgagaaggcagctgcattcaagctaagaagacagtgctcactagggctcctcaccaaatttgccagcaccttgatctgggatttctagcctccagaactgtgagaaaataaatttctgttgttcaagccacccagtctatggtattttgttatggcagccctagcttactaaggaacaactactgatataatcataaactagctgcaatcgtcagttagcttcagactttgtaacgtagccagtagagtgatcttaaattccatgtaatttgtaactcaagtaaccatgtaacttgaggtcgccctgcctcagacctgggtaaacttggcttaaacctccagtttcacagcatatgaaagaccattgccttctatttaatttattcaaatttctaaacttagtttttcatgatccctgtggattcattcctgcaaccctaagtgttgtatcagttccactcatctgccagctggtacatggaatatcaggagcttcaccattgtccataagaaattaaattaaattcatgattttgtgactgttccaactttaattaagtctccaggagttgcggaaggaaattatatcccacaccgcgcagtcttctgcctcctaattggtttccctttgacactgcattggcttccaaaacttactgtgtgatcatcctcacaaccctcaaagaaactctagcatcccttccccttactaagcctaattcacttcctcagccctttacacagaaatctaaccatgtcgcttccttgtgtgaatgaaagcgataatgccatctcctaactgccaatatgcagtgacttgactctggtttagcaattccaggaccgctgaagttttcttcctctagcctccaacatatatcacccacaaatgatacccataaagcaccttccccctaatgggcatggcagctactctgtcctggacctagatgcctggcccagtgatgtcaatgctatacttttgccttcttcctcactgctctttaaggaccagcccctcccctctctcaggccaccctccagagacatctttcggttatcttcagcccctctctaagtgccttgcacaaagtgtggactcagtggctgtatgatacatgaatatatgaagaagtaaacacccatgcttgaaatcttccaaggggcctcactgcttagaggatgaaatctaaaatctgaagcctgatgtacagagtcctccagaatctatgcccagcctatacttcccctggtccctcccccaaccccacccccaactttccagacaccctcagctcttgtcagggacatgaaaagctgcctctgtctcctggaagcaatgggtagggatgaagagacaggagtgggctaggcctctgactttacctgtgcgagtgctggaggtttcaaacaatttttctttttcagtctctctccgcctagaaggaagcagaccatccatgaaatgaaggggtctaaagaatcatggtctcttctaacgttcctcctccaggatcttcttcccccttccatcttgaaacttacaatcctatagcatttgcctgcaaggattcccaaatgtcattttcttctacagataaaaagattatgggcgaggcacggtggctcacacctgtaatgccagcactttgggaggctgaggcaggcggatcacctgaggcggggccaacatggtgaaaccccatctctactaaaaatacaaaaattagccaggcatgggccaggcagggtggctcacccctgtaatcccggcactttgggaggccgaggcgggcagatcacaaggtcaggagttcaagaccagcctgaccaatatggtgaaaccccacctctactaaaaatatttttaaaaaaaattagctgggcatggtggtgcctgtagttccagctactcgggaggctgaggcaggagaatcgcttgaacccaggaggcggaggttgcagtgagccgagatcgtgacactatactccagcctgggtgacagagcaagactccgtctcaaaaaaaaaaaaaaaaaaaaaaaaaaaaattagccaggcacagtggcaggcacctgtaatcccagctactcgggaggctgaggcaggagaatcacttgaacccaggaggtggaggctgcagtgagccgagatcatgccactgcatgccaccgcactccagcctgggcaatagactgagaccccatctcaaaaaaacgaacaaaaaaaatattatggcccagaaagaagcagttgttttcccagggtcacctagcaactaagggacaaagccagagctaaaacccagtcttcctggtttatgaacttgctctttgcacactgctatgccatttcatggaagatgggaaggtggaggcacttgttctggacaatattcaagccctgtcatctttcaactgctccacattgaatccatagtaataggcttgactaagctttagtgacagtccctatcctgaaaatattgtcttatttgggggaggtcaaaggggtgtgaggaactgcagactacatgagaagagagattcagattataaacgccatcttgccatgtgggattacgggaagagcgtaactcttatttttctcaatttcctataataatccatttattttggaaaaaattcatttaaaattatatatatacttaccagtgaaaacaaaatatggcaacaataaaaagcacagaaatgatatctgcaaggagccacatgaacacatagaactttggtgtctgaaaaacataaaccacagtgaaagaactttacagttagaagggattttggatcatacggtctaagtcccttgctctgctgccagggctggaggaggagaggaagaggggatagacaggccaaggaaccttgattgatgtggcattctcaaacacagacagtccctgcaagtgtcctaacagtcacccttatacatgcagggggctctagagggaatagaacacttcacacctttcatctcacctttcatctcccaagacagagggcagagggggtcccagagaagtcacacaacaagtctattctggacccaagaccacagtccaggttcttgacttctactgctgttttcaaggcatggcttctcaaacctggctgtgcagccaagtctcccggggcagcttttagtaatacaggtttctgggtctcactagacacctaaggaatgagaatctctgcatttttaacacattcccaggtgatgctgaagccatgtgtctgtaagccagcatttgggaaccattgttctaaagtatcacactttaattaagaatgctgaagtacaattaccccttacctacatgctcctcttctatgctccttgcccaaatcatctatttcccagagctctgtcttctgggtcctctcattgagtttgatgctccctttccacctcaattgtgccctctctaattccacttgatgctaatagggctggcacattttatcctttctcagaccactctccaccctatcccaaggtctttccttgagctgaataataaaattaataacactaatgatcataattaacaataagcaattaacaggagccaggcaggtattctaagcacttcaggggtatttacagatttaagcctcataatagccctactagtagaaaatcttaaccaacttccactgaactgaggctcttaatcccctctgggaaaaatattgactgagggctgctgtagttggctgattgctccaagaggcctaccagataagcagaatgttcacaaagaatcagttatccttgtttcccaaatggcttaagtcaactgtacttgttattgtaatagtgcaatgtaattagatgctgcttaaatttgtgagatctgagtgaaaaaagtatgtcattttcaaagaaactaagtcaaatgctttgaaaaactcaatgaggacaaaatagatcattaaagaatagacagcaattagattaggtgtaggtgaaacactacaagggtttgagggattataaagatctaggtagattgctcattcagattgattgtcctaatgactttaagttcctgttctgcttaaaacaaacagttagaaatcctagctagttcatctggatgtttaaatgagagaacatagaactcgatcagcagaaatatcctcaaagaaatgactgtcaaaaggtgaatgaatattttaaaataaaatttgtgaagtatgtatgtggcatactgtttataaaaatgaccacaaaattccttccaaacctatatgcaggcccctacacaacgtgacttagctgtgcctccctatcaagaggtgaagtctgtttctctcccaccctgaatctgaatttggccaggtgattttccttggccaatggaacatcagcaaacataacactgtgagaactttgaaaagtccatgtgctttggggcttgctctctcttgctgttgggaacccatctccactaggtgaacacactccagctagctgccttgaggatgagcgacgacacgaagagaaacttggtcattccaggtgcgcctctagacaaatgaacaaggcatcctagactatccagcccagctgacttggctcaaaccagagacaccacctagccatcagccagaattgagacatgataaatatttgtttaagacactaagttttaggtagtttttattaagcattaaaagctaactgataaagtgtatatcatttttaaatgattcctcactttaattttctcaattacgagaccaatgaccagaccagattatgttggacacaagtgtttctactgcactattattatccccaattttcaaacagaagaaacaaaaaagccaaaaaccacaaacacattaactagtatttccacattcacacagtaagtaatggagccaagatctgaatctaaatctcaatcagtctaactctggagtgtaggcttcctgttaagacctctgggacaccagcctcacctccctgaataaaatgacacatggcataggctgggaaccatgcattgggtcctttaaaaatgcctagactaggtgtggaaggaagattggttttcttacatatatccttttaaactttttgatttttgaatcacatggatttattcatttaaatattaaaatgaaaaaaacgcattcagaaatagcatcatttaagtaaatgtgtacctcccaaagggacaactttgagacattactgattcaggggataggattatggaggggtgtgctgctttctaaattatgcatttttgtaatgactggattttaaaatgttagaaaaacacatagtatatacatgaaggggagttatatggggacaggtgggtggaaaggctccacctgtgctgagtgacctgccatccaaagctcccttcagggtcatctccaggaagctgaccaagccaccatagtaagaagtcagcgatttctcctgtctaccagagggcctagatgcagttactggccctgtaagactgtgccttgactctggatcccttttcccctggtcctgaccctgaacaggtcagaagctcaggccagagggtggagatctggaggaggtgacttgaggccccttccctcttaggcttctctgacaaaggctttaactttcaaggccatttggagtttgggttattacttgggattggactcttaattctgaagtgaggctttttgatgactaaaagtgaacttctaaaagttatctaacagtgactggaaaagctacaggacctaagtgagatttcattcaggggcagagaaaggcctacatcacagaccaggtttaaagaatcaatgcagcgaaattaaactgttttctgttgtatgctattgtgtcccactcagtcaacctactctctgtacagataagaacaagttctgtagcagtaactggttagctagggctccctccacagatagtgataggatttggctgggatcgtaaaccaggtcttcaggttctcaagcttctggcagtaagcaacagaaggcctagaacatgcaactggacactggctaccctcttcaaaagccatttgttagggcacacagtttccactttggagtcaagtacgcttggttttctccccactctccatgccgttgtcaattgttgccatgcctctacaaaggtggggctacagtaacaaaactctgaagtcagacctcattctgaatcctgcctcatgaaaccacatgcaaagatatctttgagcttcagtttcctcatgaagatgataacagtggccaattcaaagggttaaatgacataacgcatgtcaagcacattgtaaggattcaataaatgtcaattattataacaacactaatttttgcctgaaaatcccagaaggatctgtgagaatggaaaataccacatctccaatattcatagaagtctgtactcttaagtggctgcccaggggatggcacagtgggcaacacagggctggggggcctgcactgctatcataccaagcctggaagaacaatctggacaaccagctcaccatgaagaagtgagggtgatcaagctgactcaggagcccaatgttgtctgtggtcactgagttaatcctggagcaccaggccagtgagaaaagccaaggctcattgacggtgtatacgttgatatggatgttagctgctttataatctctggaacaaaaacagaacccacaggggatttagatcaagtttcattctcatcatctaaaaggagaacagccaccatgtttgtgaaaggctgttgcctaaatcaccagaagcagctgatccagggacaattcatgatacgatgtgacagaatgggctcatagtacaataagataaaggattggatttagcacctctgctcctgtagcaacagtggtgtgctggtaaaccaaatgtcctaaggagaataataaaaaggaagaaagaaaacatattgaaaaaaaaaaaaaaaaaaagaatggggaaaaggaaaaaggaaaaccctattgtagcatatgcaaatttccatggtaaaaacactcctaccatagccaactgtaagctaccattggtagaaccaatttgcagagtttctgaatatttaataacaagctggtatgagctggctctggcatgctactatgtagcagcacctatatactcgcttctatcagagcacttatcaccccgtactcgaatgatctgctcatttatcagttctttacttgactctaagcaaactaaaagcagagactatgtcttatttgtctctggatactcaatacctagcataatgccaggctccacaaatattaattgaaaaaataaataaatgagtaccaatctggtgaacttattaaatttcaaatataaggaatttttgcaagtaatgaaaatagggggaaaacctaatttgtcccatggcactaaatgtcagtggatacttgtgaactgtttatagagacagggagaaaataagtggaggaacacctagtaattccagctaagttgtcattttcagggattcaatttctcagaaaacataccatgtaaatgccttcaaaaaattttttcaactctcaaatggtatggcatattggaaactgctctgtacaagcctgggtttgaatcccagttctgtcatatacgagcttagtaaattcttggcctcagtatagaaactgtaaaataataataatgcctccttaacagaggtgctagcaattagttatccaatatgttagaattgtctctgaaccaatccctgcagataaagataaattttaaaaataaaattaggaaaaaatagtaaaaagttacttatttttaccttttgaaaccaaaactcaaaaaccaatcacattccttgtttgtttaaattttaaattcaggagatacatgtgcaggtttaatacatggatatattgcatgatactgaggtttgaatctgctacccaaatagtgaacatagtaccccacaggtagttttccaaccctttcccctgtctctccctcctccattttggactccccattgtctatcatttccaactttatgtccatgtgtacccaatgtttagctcccacttataagtgagaacatgtggtatttgatcttctgtctctgcactaattcacttagaataatggcctccagcttcatctatgtgctgcaaaggacatgatttcattctttcttatggctgcatagtattccatggtgtatatgtgtcacattttctttatccagtccaccactgatgggcagttaggttgattccatgtctctgctattgtgaatagtgctgcaataaacatacaagtgcaggtatctttttagtagaacaatttattttcctttgggtagatgcccagtaatgggattgctgggtcaaatggtagttacatttttagttctttgagaaatctctaaactgctttccccaggggctgaactaatttacattcccaccaacagtgtctaagcatttccttctctctgcaaccttgtcaatatctgttttttttttttttttttttttttttttgactttttagtaatagccattctgactggtgtgagatggtatctcatcagggttttgatttgtatctctctgatgattagtgatgctgaggatgttttcatatgtttgttagttgcttgtatgtcttcttttgagaagtgtctgttcatatcctttacccactttcttaaacaagtggagtgacatatgtgttcatggattggaaattcaatgtagtaaagatgtcagttctccctcaaatagatctgtaagtttgatgcagcaaggtttttttgtacaattagcaagtggattataagattcatatggaaaagcacagccctacaataattaaaacaatctgaaaaaaaaatagtgtgagagggaatcactctatctgatgttaagacttattatatagctacagtaagcaagctagtgtggtattagaggagatatggacacataaatcagtggaacagaaccgaaaaccatacaatagatccatacaaatgtgacaaatgatttttgacaaagatgcaaaagcaattcaatggaagaaagtcttttcaaaaaataatgcaggagtaactagacagctacagtttctggagaaatcagtaaaaaataatccaaagatgtaaaaattcagccggagccagacatggcagctcatgcctataatcccaatgctttcggaggccaaggcaggaggatggcttgaggccaggagtttgagaccagcctggcaacacagtgagaccctgtctgtacaaaaaaattttaaaaaatagccaggtgtggtggcacatgcctatagtcctaactactgtggaggctgaggcagaaagatggcttgagcctagtagtttgagactacagtgaacaatgatcacatcactgcaccccaggctgggggacagagcgagactttgtctctattaaaaacaaaaaaaaaacaaaaaaaaaaacaaattgaagagatagaatgagatactaaaaaatgattaactaaaaaataaaaagagagggaaggagtgatcaaaaaaccccacaaggaatagaaaggacaaatagaaaaaaaatagcatgatggtaatgtaaacctaactagattaatatgtgaactaaatttttttttcaggttcactattgttaaccttttttcctccctttttttcttgttattaaagttctagggtacatgtgcacaacgtgcaggtttgttacatatgtatacatgtgccatgttggttttctgcacccatcaactcatcatttacattaggtatatctcctaatgctatccctgccccgtctccccaccccacaacaggccctggtgtgtgatgttccccatcctgtgtccaagtgttctcattggtgaactaaatattactggacctaacattccaattaaaagtccgagattatcctactagatataaaagaacagacaaaattttgtttataagagatgcactttaaagatgccaagtggttgaaagccaaaagatagaaaaagacttattaagcaaacacaaattataaggcggccagtgtggcaatattaatacaagaaaaagtaaactttagataagattaattaccttaaacaagggacatttcataatgaaggggccaattcaccaagatctaataatcctaagtgaaaatgcacccaataaaagagtttcaaaatacaagaaggaaacacacacacacacacacacacaaatcaacaatcgcaattacagttggatatattaacagttgggtatatattggtaactgacagatagcagtataaggaaccattcatttttctttgattggggaagttgctgccagaagaaagaaggaataagtcttgatcttgagaagtctgagaagtctccttctcaacaggataacctgatcttttgtaaaaagaataataatatttaccaggaagagtagccttatatgtaatgttcttaaaaggatgttcctgtttaagtctttctttattacatattttgtaaataaacatggaacagatttatgaggcatgggtccctggagcatgacacataaactagataactctctgggactatcaaatagagatgtttcatgactcaactgctccccttatgtgtgagttaaccctgcagaaactcacttggaggcctcatctattactctgggccacagagtacatgtccaataaataaagatacctgcacagccacaatcaatgtctctccttgctttgtttgagcctcttgattgcctgctgtatccttgaaattaatgataaatctcggcagtatgtaggttatctgatatgtgaatgtttgatctgcaatctaatcctttgtattagctcaacagaaaaaggaagaaaaaatgaatataaaattttcaaaaagcctatcaaccaacttgaactaattgatatttatagaatactacacccaacaactgaagagggcacataatcttcagggggacatgagaagctcaccaagataaaccatatagtgagccataaaataagtttagaatttaagccatagaatttaaaagggttgaaagtacacaggtttgttctctgatcacaataagcttaaattagaaatcaataactgaagtagctagaaaatcctcaaatgtttaaaaagttagcaatacacttccaaataatccatgagtctaatgagaaatgagaaaactttaaatattttaagttggataacaaagaaacaatatatcaacataatttgtgggagaaaattaaagcaatgcttacagtaaatttagagctttaaggctgggcgcaatggctcatgccagaggttgcagtgagccgagatcacgccactgcactacaaactgagtgacagagtgagaccctatctcaaaaaataaaaaacaaataagtttatagctttaaatgtttacattagaaagaagatctaaaacaggtcacctaattttctaccctaaaaaagccatctattagcaagaacagcaaattaaaactgaagtcagtgtgaaaattataaagagcagaaatcaatgaaataggaaagtaaaggtgcaataggaaaaagataacaaagccaaaattcagtgttttgaaatgattaaaattcataaacccctagcaagactgatcaagaaaaacagaaaaaataaaaacttccagtatcaaaatgcattagaactaaaggtggcaattgcacaacgatgtaaatgtactaagtgtcactgaattgttcactttaaaattttatgttaggctgggcgtggtggctcatgcctgtaatcccagcactttgggaggccgaggtgggtggatcacctgaggtcaggagtttgagaccagcctggccaacatgatgaaaccccgtctctactaacaatacaaaaattagctaggtgtggtggtgtgagcctgtaatcccagctacttgggaggctgaggcaggagaatcacttgaacctgggaggcagaggttgcagtgaaccgagatcacaccattgcactccagcctgggcaacaagagcgaaactccgtctcaaaaaaaaaaaaaaaaaattatgttatgtgaatttcacctcaatacaattttttatttaacatttttttaaaacattaaaaatagaccaataacaaggagtaataaaaagtaatacaaagtctaccgacaaagaaaagcccaggacatagtggcttcactgctgaattccaccaaacacttaaagaagaactaatatcaatccttctcaaactctttcaaaaaaaataaagtggagggaataattccaaactcattttactaggccagcattaccttgataccaaagcaagatacggacactacaagaaaagaaaattacaggccaatatcaccaatgaaatcctgagacataaaaatcccaacacaatactaacaaactgaattcaacagcaccataaaagaatcattcaccataatcaagtgggattcctccgtgatacaaggagggttcatcatatgcaaatcaataaatgtgacacactgcattaacagaatgaaacacaaaaaccatatgatcatctcaatagatatagaaaaagcgtttaacaaaattcaacaccctttcatgataaaaactctcaacagattatgtatagaaggaatataccaaaatacaataaaggccattcaggacatggccacaactaaaatcatactcaatggtgaacagtcgaaagcttttcctctaagatcaggaacaagacaaagatgccaaatctcaccacttctttttgacatagtactgtcttagccagagcaattaggcaagagaaagaaagaaaaggcatccaaataagaaagaagtcagattgtctctgcagatgacatgaccttttatatagaaaatcctaaagaatccacaaaaatactaaaactaatacattcagtttatcggttgcaaagttgcaggatacaaaatcaacatacaaaaaccagtagcatttctttctatgtactaacaactacctaactgatgaaagtaagaaaataatcccatttacaatagcaacaaaaatagaattcttaggaataaaactttaccaaggaggtgaaagatctgtacactaaaaactatgaaacactgatgaaaggggccgggtgcggtggctcacaccttataatcccagcactttggggggctgaggcgggtggatcacctgaggtcaggagtttgagaccagcctggctaacatggggaaacctggtctctactaaaaatataaaaaattagcagggtgcagtggtatgtgcctgtaatcccagctacttgggaggttgaagcaggagaatcacttgaacccaggaggcagaggttgcaatgggcagagattgtgccactgcactccagcctagatgacggagcaagactgcctcagaaaaaaaaaaaaaattggtgaaagaatttaaaaaaaacacaaataaatgaaaagttatgtgtttatggattgaaagacttaatattgttacaatgtcaaaattacccaaagcaatctacagattcaacataatccctctcaaacttccaatgtaatttttcacagaaataaaaaaaaaatccttaaatttgtatgaccactaatgatttctaaaagccaagacaatcttgtgcaaaaagaacaaggctggacacatcacattccctaatttcaaaatacattataaagatgtgataatcaaaacagcatggtaatggcataaaaacagacacataccagtggaacagaatagagagcccagatgtaaattcaaatcgttatagttaattgaatttcaacaaagatgccaagaacatacaatgaggaaaggataatctcttcaataaatggtgttgagaaattggatagccacatgcagaagaatgaaattaggcccttatctcataccacatacaaaaatcaaatcaaaatggattaaagacttaaatgtaagacctgaaactaaaactactagaagaaaatgggaaaagctccacaacattggtctctgggcaatgattttttggatatgaccccaaaagcacaggtaacaaaagcaaaaatagaccaacggaactacatcaaaccaaaaagtgtctgcacagcaaaggaaacaatcaacagagtgaagagaaaacctatgaaatgggagaaaatatttaatagcaaaaaaacaaataacccaatgaaaaaatgggctaaggacctgaagagatatttctcaaaagaagacacaaatagccaacaagcatatgaagaaaacactcaatatcactaatcatcagggaaatacaaattaaaaccacaaggagatatctcacacctctcaaaattttggctattacaaaaaagatgagagatagtaagtactggcaaggatgtggagaaaagggaactcttacacactgttggtgggaatgtaaattagtacagccattatggaaaacaaagtggaggttcctcaaaaaactaaaaatagaactaacatacatatgatccagaaatcccactactgagtatatatccaaaggaagtgaaatcaatatgtcaaagagatatctgtactcccatgttcattgcaacactattcacagtagccaagatatggaatcaacctaagtgtccatcaaacagatgaatgggtaaagaaaatgtaatatatacatacaaaggaatactattcagcctttaaaaagaaggaaattctgtcacttgtgaaaacatggttgagcatgggcgacattatggtaagtgaaataagccacgcaaagaaagacaaataccacatggtctcccttacgtgtggactctaaaaaagtcaaacttacagtggggtacggtggctcacacctataattccagcactttgggaggtggaggtgaggaaactgcttgagcaagaccacgtctctatgcagaatttaaaaattagccaagtgtgttggcatgtgcctgtagtcccagctacttgagaagctgaggtaagaggacagcttgagcccaggaagtagaggctgcagtgagccaagatcacgccactgcctttcagcctgggtgacaaaacaagaccctgtctttaaaaaaaaaaaaaaaaaaaaaaaaggcctggcacagtggctcacacctgtaatcccaacactttgggatgccgaggcgggtggatcacgaggtcaagagatcgagaccatcctggccaacatggtgaaaccccatctctactaaaaatacagaaaattagctgggcatggtggcgtgcacctgtagtctcagcctgaggcaggagaactgcttgaatccaagaggcggaggttgcagcgagccaagattgggcctttgcactccagcctggtgacagagcgagactctgtctcaaaaaaaaaataaataaataagtctaacttatagaaaaagagagtagaatgttggttaccaaaggctaatgttggttactgaaaagtagaatgttggttaccaaagggttgagggagagaggaaatgttgggtcaaaaggtataaagtttcagttagatagagggaaatgttttgagatctattgcacagcagggtaactacagtcaataataatgtatatttcaaaatagctgagagtaaattcaaatatcttaacatgaaaaagatatgatatatgttaattagcttgatttaatcattccatattgtgtaaatatattaaaacatcacattgtaccctataaatatatacagttatgatgtcgattaaaaataatataaatttttaaaatgtctttaaaacattaaaaaactttgtagtatcacaaataaaacagagggcaattctatactcatatacttttgattaaaacaatgcatttaaagcattctcagttaaaacagcaagaataatctcattaaaccttttaaccactccagcaggtaccactgttattctaatttacaaaggagaaaactgacaattagaaacttttccaaagagaccaaagtagctgatggctaggccaggtctagcaaacatataacttgacacataataatagctcaataaatggaagtcataattatttttcaactactagatcaatctcaggattaagagagaaggaaatcattctagagccattttctatttgaaaaaaaaagtagaagaaaatagaaatatgctcaaaatagaagagtagttgagtaaagaaaaatcttctgaatgggaattagagagtaaaacatatataattttccaacgctaaaagaaaaaaagacactattatatgatcaatccatagccagaaaggcagaaaaagcaggaacagaaacagatgcatgcaacagccttttactaaacccaaaggagactttggatatctattatctataatctattatagataggtagataatagatatctatatattatgtatctctaacctgttatctccctccctctgtccctccccaaggaagactttgtctctaaagcatttagaatcatataaaaaattaaccttaaatctaagacaaaggggatatggattaaattaagcatgtttaataatagttaagtttggaaaagttattttattcccaggtgcttttaattctgaaaatttgtctctaattgtatatttataaatacagtggttaataattttagtttcttctcatgctcagctatttttacattttttaaataatagttttgttatattcttaattatccgttccagaaatatggctatctggatcacaaagccatttacaaggtactgccatccatctggtaatggtaggaggaaataaacgttttgagttctgacttttcaacgtccaccttttatataagaacagaaatgccaagcatacaaaaaagtgtactgaatggtgaaagattagagtacacagcagaggctaaagtctatgttccagggacacagtcaacacttgataaatgtttgttggcacagggagggagggagggagggagggaggaaggggtaggaaaaagaaaggagattcaaaggagataaccacacacagaaattccgagatggaaaggggaagttaagaagtttaattagaatgtgtattttgtgtaagtaaggcaatatgtgccaagagaggtgtggtcaaacacttaccttaacccattagggaacaacttcttgtagtcaacatttattatactgatattgtttttagcaagggtttcaatggatactaaacggcccacatgctgaaaaccaggagccacggacctgacgtattgcctatcatgagctggcaaccaaaaaatctctaaggagaaacaagaagtccctcagtagataatcagctatccaggtacgaacagccccatagagaatggagggagctccattccagcacaggtagtattctacagagagtagagagagagagtctagtccttggtgaaagagtcaacatgggctagtattttctttgttttgttttgtttttgagatggagtctcgctctgtcgcccaggctggagtgcagtggcacaatcttggctcactgtaagctccgccacccgggttcataccattctcctgcctcagcctcccaagtagctgggactacaggcgcccgctaccacacccggctaattttttgtatttttattgtattttgtatttttagtagagatggtgttccaccgtattagccaggatggtctcgatctcctgacctcatgatccgcccgcctcggcctcccaagtgctgggattacaggcgtgagccaccgcgcccagccctgggctagtatcttctaatgaactcttataatggggctttcactagggctactctggagctgagttttctcatgacctctccatttaccagttaacatcaagtgtcaagggcctactgtgtacacaaagactcatacaagcaaagtagattagttgatagatatgggtgaatagtgagaatcaaaaacatctttctggttaatgatgttaaaaatcatctttgaggctgggtgtggtggctcatgcctgtattcttagcactttggaaggccgaggcaagaggatcccttgagcccaagagtttgagacaggcctgggcaacatagggaggccctgcttctattttatttaaaaaaaatcatctttgagaggagtcatttcctgccaacagagatgctattatgactcatctatgaaatacttccatttgtaaaaagacttataattgtttcactcacagcactcccatattctgagaatttatgggatttggaacaactgactgcccaaatgcagagttgcttctgaaaaacattacgagcaaatctctgctcaaataagaaccagctctcctttctatatcattcatcatgccaagtcttcaaagccttaatgttacccaggctctttctaatggatctatgttggtgtggtgcaggtcacattagatagttattacacatattcctctttaacagggtgctgacatttcatttggtttggaatagcaaacagcctcaatgattttccccactgagataaatttaactgggtcattcctagattaccacatgtagctgtataagtaacaatcttcatttccataggaagtaaaattacttaaggatcccagggtagatgtacaaggtaggtcaagttcaactactgtgctcctaggacatgctacccacctcccaacctatgtcataaatactgagatagacttaccagatgttgctcgattttagaggcaaggatcacgcttactacttggcggacaaatgtgtgtctgagaggatgttttggtggagggcgatgaagatcaaatatcacaaattttctttccttctctgcaagtgtcaataaatcagctagtgttggaattgactgatttcttgctctttctttatctgcctctgatagaggtttcatattgtaaaatggcctgagctagaaacaaatacatcaaaaaatacataaaagcactttccagttctcctactatgtagccacacatccagctctacctcagttgctccattatcattcaatccatcaggccctctgaagtactaatcctagaaaacaggtgacaaggagagaaataaaatgtaatcatcatcaataattacagtgtttggaatggtctcttctatatcctacaacctgttgtatttgcactgaaggtcatgttcttatcctgaccttcctttccagccttctctcccataagtcaagataatacatcccttttcagtcacgctggcttcctacatgggctcccgctattctagttttgtgtaataggaagaacacatgctttggcttcaactgaatttaataccagctctacccctcccttgacttccttgccatatccacttgttaaaatcctacccttcaaatgctatttccctcatgaagctttcctttaatcttcctgaactaaagagacttcaaggctggtgctgtgatcatgcctttaatcccagcaggctgaggcaaaagtatcacttgaggccaggagttcgaggccagcctgggcaacatagtgagacccttgtctctacaaaaaaattttaaaatagctgggtgtggagatacatgcctgtagtcctaactactaaggaggctaaggcagaaggattacttgagcccaggagtttgaggctgcaagtgagctatgattgtgccattgcactacagcctgggcaatagagtgaggccctgggcaatagagtgaggccctatctctaaaaaaatcaataaataaagagacttcaatggctttgaagcccaatggcccatttttatgcctctgtatgtctcattcatatatagctaatgtatgtaaaaatagctaagcatgagaagaaactaaaattattaacgactatatttataaatatacaattagagacaaattttcagaattagaatttggacatgtcttagtacattaaagttcaatcctggctcactatgcttcttgctatgcaaccttggtaataaaaccatttaaattctccaagtcatcattgcccaaattataaaatagaggagaggaagaataacctatatatttcttaggattattttgaagattaaatatgataaaaatatttacagggtctgggagtatgtctggtacatagatagaaaagtatacaattcacattagttccttcactctctgctgactctactggagtgtaactccctcttggtgggaactgtcatacattctttgaaacgcacagcatttcacctaacacatgggagaacacacatatgtttgctacattaaatttaatagatggcaactttgataatcacttgccattttttagatcatttgagtgaaggcagtgataaaaggctacctcccaggagaaggaagtagcagaaggaagaagtcacattttcttaagactcaagtaatctctctttttctctacacaactttatcttcattctctttcatacctctcctatttcttcttcttcttcctttgacctaaataagctgcctttttaaacatttttctcaggaaagaaacaatcacattgcacagtatctccggaaaattgctaggccagaaggcagatcattgctaggccagaaggcagatctaaaccatggtttagatctgattgaaagctacaactaatggttttcttaattctcaggacaatagaaatatgcttcagaattcaagattttgttagctactaccagacctaaaccaactggttcacttaactattaaaccttcttgtgagaaaaattgttaaaagaatttatgggaaagaccaacacaagaccaaaaattcaaaatagcaaagatggtaaatatttaatcaatataagagtttaaaactagactccagtaaactttaaatagtattatgggggtaggcctaacagctgaagtacattgtgcctctttagacttaatcagaaaaataaactggaatggataaatgcctgtttagactatattcaacatgtgattgaatgttttcaaaaagccacaggaagtaacaagctagaaatgaaaataaatttctggtcctccagatgaaacatctggttcctcaaataaaaataagattaaaaggtcctctgttctctgtgcctctgtgtagacatattacaaaaagaaaggttattggaagaaccaatgtataatattggttaagaaatagaaagacaagtccgggcatggtggctcacgcctgtaatcccagcactttggaaggccgagacgggcgaatcacctgaggtcaggagttcgagaccagcctgaccaacatggagaaaccctgtctctactaaaaatacaaaatttagccggctgtggtggcacatgcctgtaatcccagctacttgggaggctgaggcaggagaatcgcttgaaccgggaggcagaggttgcggtgagccaagatcgcaccattgtactccagcctggacaacaagagtgaaactccgtctcaaaaaaaaaaaaaaaaaaaagaaaagaaagaaagaaatagaaggacaattaaacctgtccaatgatgccacatcaaggaaacattccactgaatagacgattctgataagaactaactgtaactacatgtgaacaacaatacaattttcttttctttttttttttttttgagacggagtcctgttctgtcgcccaggctggagtgcagtggtgcaatctcagctcacttcaacctccgcctcccaggttcaagtgattctcctgtctcagcctcccaagtagctgggattacaggcatgcacgatgacgcccagctcattgttgtatttttactagagacagggtttcaccacgttggccaggctgatctcgaactcctgaccttgtgatccacctgtctcggcctcccaagtgctgggattgcaggcgtgagccaccatgcccggccaacaatacaattttcttgttgatatgggcaccaccacatctaccattaattgcattactataaaaaaatcagatcaccagagtactacaaccacttaagtagtgggagtatctaacaatcctgtctttttccatgtcccaatataaaactattactttgagaccattgtcagaagaacatctctttcttctctatggcactttccctgtacatttatttatttatttttaatttttatttttcttgagttttgttcttgttgcccaggctggagtacaatggcacagtctcagctcactacaacctccacctcccaggttcaagcaattctcctgcctcagcctcccgagtagctgggattacaggcacccaccaacatgcccggctaattttttttttttttttttttagtagagacggtgtcaccatgttagctaggctggtctcgaactcatgacctctcccctataaatttaaatattagaggctgggcaaggtggttcacagctgtaatcccagcactttgggaggccaaggctggcagatcacaaggtcaagagatcgagaccatcctggccaacatggtgaaaccctgtctctactaaaaatacaaaaaattagctgggcgtggtggtgtgtgcctgtagtcccagctactcgagaggctgaggcaggagaatcgcttgaagccgggaagcagaggttgcagtgagccgagatcacgccactgcactccagcctggcaacagaccgagactccatctcaaaaaaaaaaaaaaaaaaaattagcaagctactttgcaaaaagaaccacaagaagaaatgtactacagacaaattgtttttcgaagcctcagaaggttctatcgcacattatcaaattacagctcatatgaacgttactatattgattcaaaaaataaccaaatagacttctggtttctggttccacatgtaaggagcttggaagctgtcactccatcctaacaacaagtaaaaagttgaacagaatgaaaaatcaacaactcttattggatctgtaatagaggtgaggacacagggcaaactgctgcccagaaaattggagacacaggtgaaaggagatgaatcatagcttaccagaatgagcctaacaaatggaaaccactaaggaaaccagtgctcgggtaggaaaacttgaaccatcactgacaaattcctggaggattagtgtggacaagtctgagagttaaaaactcaaggggacaccttgagatacgtgattatgttgcttatttgaaatctttctacgttttttgatgtaggcatttattgctataaacttcactcttaacactgcttttgctatatcccataaggtttggtatgttgtgtttctattttcattcatttcaaaaattttttaaatttccttaagttcctcattaacccactgatcattcagaagcacgttgtttaatttccatatatttgtacagtttttaaaaagtataacatcttatttgtaaaaagcttaaatttgacataaaattttataaacacagtattatctgatttttacattttctcttttatttgagccaataaaatttatttttttaacttttattttagattcagtgagtacatgtgccggtttgttacctgggtatattgcatgatgctgagatttgaagtatgaatgaactcatcactcaggtactaagctcagtacctaatagttagtttttcaaccctggcccccttcctccttcagtagtcccaattttctattgttgccatctttatgttcatgtatatctaatatttagctcccacttataagtgagaacatgcagtatttggttttctgagcctgtattaattcacttaggataatggcctccagctgcatccatgttgctgcaaaagacaggatttcactcttttttataagtgcatagtattttgtggtgtatatacttgtacagttttgaaagttcctctcattgatatctagtgttattccattgtggtcagaaaagatacttaatatgatttcaattattttaaatttgttgagatttgttttgtggccttacacatggtctgtcctggagaatgttccatgtgctgatgaagagaatgtgtattccatagctattttatgaagtattctgtaattgtctgttaggtccatttggtccaagtacagtttcaatccaatgttgatcttttgtctagatgatctgttcaatgcccatagtaggatgttaaagtcaccaacatttactgtgttggaatctttctccccctttaaatctaataatatttgctttatatgtctgggtgctttagtgttgagtgcatgtatatttataattgttacatcttcttggtgaattgatcactttattatttcataatgaccttctttgtctttctatggttttggaactaaactctgttttatctgatgtaaatatagctattcctgcttgcttttggtttctgtttgcatggaatatctatcccttcactttctgtctgtatgtgtctttacaggcaaagtgagttttttgtaggcagcatatagttgagtcatttcctttattcattcaggcagtctgtatcattcaagtgactaattggtttacattcaaggttattataataggggatgacttactgtagtcattttgttaattgtattatgtttgttttgtatattctttgtttcttcttgtttttcatttcagtctgatggtcttctgtagtataaaaggtttgatttttttttctctctctcctttgcctatctgctctattgatgagttttatgcttttccatgttttcataatggtgattatcacctttttgcttccagatgcagggatcccttgaatatttcttatagggctagtctagcggttttgcattccccagtttttgcttgtctgggaaagacttcctccctcatttctgaagaatagatttactgagtcaaatattcttggctggcaatatttcttctttcagtactttgaatacctcattctactctctcctggtctggatagtttcagctgtcagtctaatgagaattcctttatatgtgacttgatgcttttctcttgctctttttagaattatttgtctttgacttttgacaatttgataaaatatgccttggtgaggaccttttgggattgaatctatttgggaacctttgagcttcttagatctatatgtccacccctctccccagatttgggaagttttaaactattgtttcattaaatagtgtttctatggctttccaactctttccctcaggaacatctacaatatgaaaatttgtttgcttaatagtgtcctttattgtaggctttctttattctttttcattctcatttctttttttctcctctgggtaattttcaaatgatacatcaagctcagagattcttctgctgaaacaagtctcttgttgaagctctgtactatattgttttattttggtacttgaattattcagctgcaagggtgtccatttgggtttttttgtttgtttgttttttttttgttttttttttttttttgagacagagtcttgctttgtagcccaggctggagtgcagtagtgtgatcttgactcactgcaacctccccctcccgggttcaagcattctcctgtctcagccttccaagtagctgggactacaggcacatgccaccacacctggctaatttctgtgttttttagtagagacagggtttcagtatattggtcaggctggtctccaactcctgacctcaggtgatccagccgcctcggcctcccaaagtgctaggattacaggcatgagccaccacatccggctggttcttttttactgtatctatgtttttgttgaatttatcattgacataatgaattgttttcctaattttgttgaattgtctatttttttgtatctcatggagtttccttaaggtaattattttgaattccttttccagtaattcatttatttccttttcgttcaggtcttttactagagttattatgttcctttggtggtgtcatatttccttgctttttcatttcttgtgcccctgtgctaatgtctatgcatctggtggaataatcacctcttctaaactttctagagtggcttttctagagaaagattttcacctgcagttgggtcttagtgcactagttgagaagggtgtggtgactttgttcctgggtaggtgcagtggtatagtctctgtgcagcttctttggctgcattcagcgtcagcaaaaactgtgggcatctcagtggcttaggggtgtggaaatttgttgtcgcaacagcagaggtgtatgttgttaatgtccttggtccacaaatgcttttggtgttctccaattcttgttttccctacaatgaggagacttcactgaggggatccctcttggtgtcaggtctgacacggcctacaatcaactgccatggtgctggattccaggtgcaaatgtttacattggcagagtcctaggatcagagtctcacaaacctatttgccctctctgtgaacctttcactctctgtggcagagttggacataggttgcccacaccatcagactccaaccccttagcagcttgagtccaggaagttaggctgtagctgtgactccactcttgctaggcagggaacagccctggactgactctaaggaagaaggtatgttctggaggtttgagcctagggcacagggtatggctataatttgggagcttgagccaacagggctcagtggcagcttgggtgccttgggatgaggcaccatgtagtggcaacactagactctaagatggtaggattcagcagtatctcagactctgtgaggccaagtgcagcagccaagtaccccagtatggctgttgtttgggtcctggggggcaagaagcagcaccatgtgactccattccttagggatggcactatctcagcagcttagactctagggagctagtccagctccagggaagcagggtactacaattgtttggcctgtagggtcgggtatctctcctcagacactggtttgtttccctgggatgaagggtactatgttagctcagccatggaacgtgcagttgctcagctcagccaaaacattgattctccaagggttgatgtgccactctactcaggccttgggggcctgactgttctgagcagcccaggcaccatttccctgccacacagggctctgacaaagtactttttccttgagagggcagtgcacagtttcaactcaggaccccagtggcagggcatagccaagtctgaaagaggtagatggagctgttctgccaaagcaccgtatccccaggaaagggcacacagctccatctctagcccaagggtacagggggaggggtaggtgaaacagttctatctgctgcttggctccacagagaaaggtgtaacagttgcttggcctggggatgttaggccactctgttggggtggttccccagtagtttagcataagggatgaaggggtgctgtggctactcacctctggagcaagatgtgagtagttccaagatggcattgcgcagtagccatgtaggccacggggcaggcacagctggctccttctctgaggggaacacagttgtatggcctctaggtagctaccccagctgggcttagggcctgtgaggactgcaggggaccccaataggggtccaagctgttgctgggggctgctgggatcctcttgcctaccttttcaccatagagagaagttcctcctggttcctggctgatctcagctgggggatgaggtggcagggtcctgttgtttccttccattctctatgtgggtctcctgagtttctgtgctcaccagggtttctgttactcctctgatgtactctggtgctgtcctttattttcattaaaatatgtttttttatttattgttttggctgtctttgtggaagggatgagtgctagtattttctagttgaatatcttgctgtcatttctcctttgagtgggttctgtcatcctgcctgttccttcattaatgtgataaataaaacttgtactcatgccaactatgtatctgcatgaaaattatatttttatcatttctataattatactttcacaaaaggatataacaaagttccacggaagtgttggttgggctaaagaaacaggaattcagtttagcttccagtatcaactcccagaatgtctgtatctattcttattttgttataagattaactacttgattttcacaataatctcaagattaataaatacattaataaataatgaccaattcaccaccatgatcaatcaataatcatacccaaccaataaagaatcatcagaataatctttactaatttcttcactatggaaaaaactacccaaatctccaaatcttttaaatcacatgataacaccatttcaactaccttctaaccatacagcatgaaagcaaagaaagctccacgatcaaacctaaagataaagtctccagacaaccatatttgaaccccaggtttcaggatgctcttcagtagccattgaagtaggataactaaatgctacaagcaaagcacctaaacaccctaaacatgctaaaacagagctattaatgctaaaaaaatgcctaccaaaagtcactgcaataacagatccaaccctatcacttacaactaacccaaacattcaaaactggagacagttttgaagaaatgtttgaaaaccaaaaataaggccaggcacagtggctcacatctgtaatcccagcactttggggggctgaggcaggtggatcacctgaggttaggagttcgaggccagcctggtcaacatggtgaaaccctctattaaaaacacaaaaaattagctggtcatggtggcgggcgcctgtagtcccagctattcaggaggctgaaggaggagaactgcttgaactcaggaggcggaggcttcagtgtgccgagatcatgccactgcactccagcctgggtgacagtgaaactccgtttcaaaacaaataaaaataaggctgggtgcggtggctcacacttgtaatcccagtactttgggaggccaaggtgggcagatcacaaggtcaggagttcaagaccagcctggccaatatggtgaaaccccatctctactaaaaatacaaaaaaattagctgggcatggtggcgcgtagctataatcccaattactcgagaggctgaggcaggagaattgctcgaattggaacccgggaggcagaggttgcagtgagccgagatcacaccaccgcattccaccctgggctacagagcgagactctgtctcaaaaataaataaataaatataaaaaaagaaaactaaaaataaggatgctatttaataagttattaagtattaaatgtttctgaatgtacttagaattatgaaaaaaattaaattcatggttcccacatggtagctaaccatgactgctgacatgagaaacaactgttgtctttcagcaataaggaccactaagttccaataacgaccaagaaaaagcatccattaattaaaattcatcaactctactgttccatcaaacatctcagcctgatgaaactttggctcaattttaggagtaagtttaattctgtaaatcctaataagacttttatcagccttatattatacatcagatacaataataggcttttcatctagaacacacctttgccaaaatattaactatagctaactaattcaatatatacatcctaatggagcacctctagtttttatgtgtctatatatgagacatattgcagacgctacatatactcagaaacctagaatatcagagtaatcacattattttcatatatggaaatagcatggatagactatgtactcctatgaggacaaatattctgagtaactacagtaataacaaatccactttcagctatttcttatatcaatactaattaatacaatgaatctgaagtggagtctcagtagatgatacagtttggatatgtgtctcctcctaatcttatgttgaaatgtgacctccaatgttggaagtgaggcctagtgagaggcatttgggtcatgggggcagatcccttatgaatgatttggtggcctccccttagtaatgagtgaattctcattctattagttcaagcaagagctggttgttgaaaagagcctggtacctccttctctctttcttgctccctctctcgccatatgacatgccttgctcccccttcatcttctgccatgagtaaaagcttcctcaccagaagccgagcagatgctggtatcatgcttgtagagcatgtagaaccatgagtcaaataaacctcttttctttttaaattacccagtctcaggtattcctttatagcaaaacaaaatggacaaacacagtaggtaagtccatctgtacataattcttcacttttccctatttttacatgaaacatgatcaaacggccctcaggattaacatcaaacataaataaaattccattccaccagtacacaatcaaaaatcccttttcttttcctaattacactactaccgtataagtgagctattaccacagctgaccctcacaccttgctatctctgctgtcacatgtgctagcaatatggatgcatgctatctatcttgttgagatgtttattttcaaaatcaaagtctcaaatgagtatagctgattggtcagaacctaggtcacatgaattcctagtcataaaataagctagaaaacgtaggttgttttgttttctttaatctatcttgagaaagtaggcttgacctttatcaaatgcaattctgactttttacccacttaaaaacactcaaggataattctaaactctttaacttgttatgtaagcattgccataatctccgatcaacatgttttccagattattctcccaatctatcgctcatctacttcctacccctcttccttcctctcttctttcctctatccctccctccctctcctacacacacacacacacacacacacacacacacacacacacaccctgttgctccaggataatctctgaaacacatcatcattactgcccttgcttccccttggtaatgatcttccctcagctcaaatggtagctgtgcataaagtattccccaacttcttccagaggaaccattcatacttgcctcaaaattacactgtacactgcacagcacgtgctttatactgtaccacatccattattagtctatacatctccttccagaatctcccatctacattcctcagtctgagttagaagttgttcttgtgtgctcctgaagcaacctgaaattaactcgttttgctcttatcacaatgtacagtaactgtctgtttcttatactagcctgtgaattccattaaggctggatgtgtgtttattcaccattatattccatgtgccttgtaccattaggtgctcaataaatatttgttgaatggcaagcagaaaaaatcaaaaatatatgtcctagtctgcctcatctaggaaaatgttatgtacatgttagccatactgtaaaagcttatgaaatatttgggtaaaaagaaattacaagataagggtaagtttacaagtttgtcttcagactttctagtgaatgtagaaagcagcaattagactcacttcattactgaaaaagccctcctgccaatactatagtcctgctaccaaactgggatgaaatcgtgtggatacttgcctatcttcatctatggcctttattttcaggagcagcacatgatctcttacaaaaattcaatgcaggtttgtggaacttgggaatgtgtcttacctctggttttacaaaccatttgcctgcattcagagtcgataggaaatcccagttgaagaaggcagggttctcgcaggcagattctggctgaacttccccaatattggttgttcttttcaggtcaaagtcatgcatgaggaaaggcacatgatcataactgaggcagaggtagaaaagaagggcaggggtagataggctgaatttagctaccttggtagacaggctccccagacagtccttcaaggtcacaagtgtcactagggctccttactccctctcaaatcttagaaaagggctacatatcagtcatttacactttgatgtcaatatttttctgctctagggatcaatctttcatgatatataatcacattagtgatcgtgaaagactagcttctctattcaggggctttctggcattaggaaaacagcaggcacagtagtggcctgaaaataaagtgaatggaggtagggatgatgcaaggtcctcaggttccaggaccatactaagcaggtgtccacacagttttcctgtattattctgatcctttcccagctaggcactgcactgagtatttctttttgtttgtttgcttggtttttgtttttgtttttttgagacggagtcttgctctgtcacccagactggagtgcagtggcatgatctcggctcaccacaactgtgatcacacaagtgattcttctgcctcagcctcccgagtagctgagactacaggcatgcaccacaacacctggcttatttttgtattttttagtagagacaggattttgtcatgttggccaggctggtctcgaactcctggcctcaagtgatccgcccacctcagcctcccaaagtgctgggattataggcatgagccaccgtgcccagcctacactgaatatttctggtcctagactttccacatcagatagtatcataaggtaagttccttgttcttctatctgcaatttgctttggagaatctctgattttatgaaactatctctccctttctcattaaaatatctatgaagagaacatctataatgaggaagataaggcttagaacttactcttctgctataagccactagaaaactggacaaaataaaggaaataactattttcagttaatggacaaaaggatgcacaatattactacaatctctgagaaaagcaaaaaaaaaaaaaatgacataagcaattccatcgcccaggcttctttcctgcaggtgaatactgaatttcagtacagggtgggggaacctaaaagggacctagctgtcttgctgaaatgagaagaaagagattagagtaaggggggagccaagacagctagaatttatgggctagagtcccataaaggatagagttatgcaaaaacaaacacacagttccaagaaaatatgcaaaagtccataagtgtatggctaaatatcaatctgtatgtgtacagagtaaaactatgaagcttggcaagaacaacttctaagaaaagaaaatattaccagacagttctaagacaatcggagcttgcacaggggtatgaatcattcaagttccatccagcgagagaggagagtcttcagtaattacataggctttctttagagactccagaagatcacaccttagaaaaggggataattggccaggcgcggtggctcacgcctgtaatcccaacactttggtgggcggatcatgaggtcgagatcaagaccatcctggccaacatagtgaaaccccgtctctactaaaaatacaaaaattagccaggcatggtggtacacgcctgtagtcccagctactcaagtggctgaggcaggagaatgcttgaacctgggaggcggaggttgcagttagacaaaatcgcgccattggactccagcctgggcaacaagagtgaaactccatctcagaaaaaaaaatggtcgggggaggggggggaataatttagaactacaatggccttagagccactttagatcctctaaaaaagagcttaaaaacaagcttcaaaagaaaagaccaaactagtctggaagtaacaactatctgctagaaaatgaccaaccttaaaggatacaagatatagcacccaacaatgtaaaactacaagtccagcatataatcaaaacttactagagatataaacaagcaggaaaatgtgaccatatggaagaggaattactcaacagggacaaactcaaaagtgaaagagatgacagaattcatagacaagggtgttaaacagtgtagaacaaaattataaaggtgtaaacaaggtatgtaaaggaaaacatgaacataatgaagatacacatacaaggtataaaaaacggaaatttagagataagatataataactgaaatgaaaatttcattgcatgaaatttaaaacagatcagatattgcagatcatgcaaagaacaatgaatttaaagatgcagcattagaatctatccagatgaaagcatagaaagaagactgaaacaaaaaagaatgaggcatcagtgacctgtaaggcaatgatcaagcagtattatatatatgtaaatggagtcctaaaaaagaagggaggtgcagaaaaaaacatttcaaaaagtaaaactaaaaattttttcaaaatctgatgaagatttgaactgaatgctgaattctttcctggctaaaagtctccaaactaatgtcttcaaattctctttccatttttctcacttagactcaatgaaattactactatatttttcctgcaggcatatcttgtgatacataaactacaggcaagaaaaatatgtcagattgccactgcctgcttccacgttaactgaagatgctttgggcctaacatctttttttttttttggaaacagaatcttactctgtcacccaggctggagtgtagcggtgccatctcagttcactgcaacctccgcctcccaggttcaagtgattctcctgcctcagcctcccgagtagctgggattacaggtgcccaccaccacgcccagctaatttttctatttttagtagagatggggtttcaccatgttggccaggctggtctcgaactcctgacctcaggtgatctccctgcctcggcctcccaaaatgctgggattacaggcttgagccaccacgcccagccaaatctaacatctagacacctcaactgactgccctccagactaaggaaaccgatttatagatttctccaaacattacatttgtttttcttccatttgaaagctcatttgcaatactaactcctgaaacgagacacagctgtttaatgggactgggctattcccagaaatagaagactggtttacggggatcctttgccactcagctattaactcagttttcccaccaactcagcttttagtgtgtgaaacctctagggaagcttcagatggggatgttggagctcagaaacctacacccaaattgtggtatgctgacatgctgaaataaagaaggctgttaggcataatggtttaagctctttggcccaggcagttctgaataattaaattgtattagatttccttttggcaaaacaagtggtatctgcgcaatagctaataccacttgttgtgaatagaaaaaatttccaaataagctaaatagttatgagaggtgtgtaccacagattccccttaaatgatctctttagctggcttcctaagggaatgggaaactggttttagttccccttacaaactcttattattgtcatcttgctcttctttctattcacaacagacaatgaggactagtaacaaaagaactgacacttttgtcatgcagaatcagaaccctatacctggcactcaagaacatttacaggctactacaaagcagtttcattcctcaaatcctaattatggtacccttgacccctgtcagcaggaaatcagccaaagcagtcatggcccaattcctccttaatgatcacacttcaggactgagggataaagaagataagggggtactgaagccatcctcacagggttaacaagaattctggacagaaatatagctctaattaagtattaatcaggcttcattttgaaccacttccttgtaatggaaaatcatttgacattgaccatttgcatccccagtgtatctatagataggatttctgacattagaatcacaaggcttttgtttaagaattgcttaagatgtttttcagatcccatattccggtaaaacagctgatatgaaccagtttgaggacccccacagaggaacagaatcagcatgagaatatagtttcttcatctccctgtcccttgactttaccctgtactctttgaccaatcaacgatctgcacacttcagcccactccaaaaccattaaaaactctagccccaaactcctcagggagatggatttgaggtttcctcctatttcctcatttgatgactctatcactaaatctttctctgctgcaaaaaaaaaaaaaaaaaaaaaaaggagctggggctaggggtgggcatatgtggaggagaatacagataagcatccagaagatttcttatcaaaacataagacagaaaactaggaaataacaatttttacatgcttgaagaaaacaactgtcaacttagaattctatatgcagcaaaaatattcttcaaaaatgaagggaaaattaaaatatttcatacaaacaaaaagcagaataattcatttccagcatacctttactgtaaaaaagattaaaataattattagacaaaaaggaaattgatacaatttgaaacttggatctacacaaaagaatagtgccagaaatgataaatacgtgagtaaatatagaaacttttttctcattttttaaaaacagaattaactgtttaaagcaaaaagtaatagcaatgtataatgaggttcgtgatagcaccaggtcatactatgagagagatgaaatgttagtgtactgataaaagacatatgctttacacaaaaatgtataatactcaaagggagaaataagttaaagatcatattgtaaactctagcacaacgactgaaaaaaaagaaaagaggtatagctaataatccaacagtagagatgaagttctaaaaaatgctccattagtccaaaaggaggcaggaaaggagaaaacaacaaaatgatagtgcacttgccatgggtctaaaatttaaaggggtgccaaaaactaataagcaagataaatactattttaatacaatatttaaaagacaaaaccaatgcaaaaatccactataaacaaaatattaaattttaaatgaagataagatagtattactgatttttccttttgtctcaggttctcatatggcttggcatgacacatcttcattaaaatttttgacattttgttcatcatggatgctaaagggtaggcaataccaacagaaactagttatcacacacatacttgttatgtgtgacatttacatttatttcccttaaaaagttaggcggagactgcattagtagagagggagtaagagcaataggcacaaacaagcttattgggatctttcaatctaactcagcttccatggacttccagtgactgttggcaagatttctcctattggtccacacgaggaggtcaacatttcttcaggatctgtgtgtttctgcaatccccagaaaacttaattcagtgttctccagagaggtgtatggctggctgggcttttatgctaaaaattttataagaggactgggaataatagcagccaaaaattttgcgtagatcttctcagaatctcccataggctttcactcagatgcaaataacttgtttacattacttgctttttagatttaaaaaatgtctctgccttttcaaatgtttctcaaaaatatattcaaatgaaggttttttcatataaacgtgtttcacatttaagaacaacatagctgcaattttataaagtgggatgagcactatcaaattcactttggggtgaacttggggtagggatcaaacatcctttacaactatattatcacaaatctcaaaaattccaacactttaaaggcaagaagggaagaaggagccagcaaaagaagtcacataggaaacagccaggtaggaagaaaatcaggagagtatggtattctaatagccaaataaagaaagtctttcaaaaatgaaggacttctcaaatgctgagagagtaagatgaaaatgaaaatttactatgatgtttaagaagtttgaggtccctgataacttagtaagagctctgagaagtggtgtagaagaagcctgattgggataggctcaaaaaggattaaaagttatccaaaacaaaggggagaactgagagaaggcaaagaaaggcaatgttggagttcaagacactcaccctaaaatatgacggcaggagaccagaatatgccaccccaatatatacctctttggcatattgattattttgagctggttattttgagaaactgcagacacaggagaagctctgaaaagttgcccttttgtaaaggaaatttatatttataaaggaaattttcattagtaaaagtatctgtaccaataagagagctgctctgaaatcattttattatcaacagacttatatctgtttaataagacaacctttattcaccacacattttcttccctcttcttaccacaatttgtctctgcccccgcacacccctattcctttctatagctcaggaaactatacaagcttcaatcatctggccttttccttgagtttcaaatttttgtgggactcccatgtgcacataggtaattaaaattatttttctcctgttaatctgtcttatgtcaatttaatttgtagactagccaaagaacctagaagggtagaccaataaaaccttttgatcctctagagcagtacagaccactctttggaggaatgctgcttaaaagaaagtgaagacatggagcataaactggagcagtatatagggcctagaaaagttttaaaatgtcagaatggatcatcttctgattttagaatcactttatctatatcttttcttaagaaagctaacgcaattcttttctttaaattctattttgagaggattgtagattcacatgggtttgtaagaaatacagagagatcctatatacccttagcccatttcccctaatagtaacatcttgcataactatactatactatcacaacaaggaaactgacactgataaaatctgtgacctcattcagatttcattcgttttacatgaacttatttgtatatttagttctatatttagtttacatgaacttatttgtatattttgttaattttatcacatgtgcagacatatcaccaccaccatagtcaagatacagaaaagtaaatatacaagaagagttttgtgttaccttttaaagtgggagccacttctctgcctccttcacccctggaaaccactgatttttctccatccctttaattttgtcatttgaatgtgatcttcaaatggaatcatacagtatataaccttttgagactggctttattcactcaaagtaactcccatgaggtccatccaaatagcagcatgtttcaatagttcattcatttttattgctgggtaatattccacagtatggatgaatacagtttatttaatcattaaacctcttaaaggacatttgggttgtttctagatttgggctattacaaataaaacagctatgaaaattaatgtgaagtttttctctatatgaacattgtcttcttttctgtggaataaatgcccaggagtacaatttctggggtgtatggtaagtatataatgtgccacataatgacaattcagtcaacaacggacctcatatatgacagtggccccataagattataatggagctgaaaatttcctatcacctagtgacttcgtagccgtaatattgtagcacaatacattactcgtatgtttatggtgacacttctgtaaacaaacctgtacagccaatcatataaaagtatagcacatacaactacagataatacataatacctgaggatgacaataaacaactgttactggtttatatatttactacactacactttttattgttattttagagtatatacattctattatatatttaaaaaattaaatgtaaaacagcctcaggtagtccttcaggaggtattctagaaggcattgttttcataggagatgaccgctccatgcatgttatccctgcagacactgcagtgggacaagatgtgaaggtagaagacagtgatatgaacgatcctgaccctgtgtaagcctaggctaatgtgtgtgcttgtttcttagtttctaacaaaaaagttaaaaaaaaattaaaatagaaaacagcttagagaataaggttataaagaaagaaaatatttttgtacagctgtacaatgtagttgtgcttacactaagtgttatcacaagagtcaaaaagttacaataagctggagttaatttattattgaagaaaatttttttatgaatttggtgcaatctaagtgaacagtgtttataaagtcttcagtagtgtacataatgtcctaggccttcccattcacttaccactcactcactgactcacccagagcaacttccagtcctgcaagctccattcatggtaaatgccctatacaggtgtaccatgttttatcttttatattgttatttttaccgtacttttcctatgtttggatatatttagatacagaaatacctaccattgttctgcaattgcctacagtattcagtacagtaacatgctgtacaggcttgcagccgaagagtaacaggtcataccatatagcccaggtgtgtagtaggctatgccatctaggtttgtgtaagttcactctatgatattcacacagtgataaaattgcctaacaacgcatttctcagaacgtatgctcatcattaagtgagatatgactgtatttagttttttaagtaactgccagacttacttggagtggctatacaattttatgtttccaccaggaacatatgagtgactcaatttgtctgccagcatttactgttcttgctattttttaacttagccataccgatagatgagtagtattagttttaatttgcattttcctaaaggttaatgcagttgaacatcttctcatgtacttatttgctatctgtatattctcttcagtgacatatctacacatgtatttcgtccattttctaattggattgtttggtttgtatttgtttttgttttcattttactgttgagttttgaaagtttatatatcctagacacaagtcttttgccagacatgtgttttacaaatattgtctcccagtctgacacttgtcttttcattctcctcatagggtcttagagcaaaagcttttcagaatgaattccctggaattttctccttcccccatctctgcttggtaaaatggtatttttccttcgaggctcaacccaaacacaactttgagcacacaaattttttttcttttttttcccacacaacaggaagtgaccttttcctccactgaggttccattacacttatttttctctggaaggctcttgccacaaatggccttattctgtagttatctgtaaacatcccatgtctccttcactagctggaacatcttttaggtatgactacatcttattcatttgcatttcccaagcactcagaagaaggcctggaatacagcaaatgctcaaggaatgttaaataaattgctaaggtagtacatagagtgaagtggtaagcacggtttgcaatggggccatatgtgaatcatgtgtgaagactatatctagtgtgtctgatttgtaaccctgtcattgaaaacatggagatgcagaggtgcggtttgtgagatgtggttcatttgtgtagtacatgcatatatgccatatgaacacaggaacaactccccagggcttgctgtctctacaacctcaggccaggctggttctcttgcatggcattgaacttataccctcctcccctcaccccagttccctgctttcttaccttaagtgtatatcagtctccaatccatgggctccatgttcaacagctttctcaaaggacatcatggtattctcaggccccaactgtagaagaaaaggacatcaggccctaagcctcagagtctctcctcccagcattccttttgtggtaggggtagagcccagtaggattttggggagcagagcttggctccctgagatctcctttcaaaacctgtataccctccgtccaagctgattctgggactctgctcatctgagacaatgtcactgggcacagtaaagagaaatggactgggagttaggtggcctggattcaagtccagcctttacaatgaactctttattcttgccatcttaatgcaatcactttttctctccaggggcttccatggttctcttttcttctcttgaccacataccccacacatacttattttcacccatgttcatcatgctcagacctaccatgggtgcacctctatgtccaaagatggttggcttgggccccaaattctccttctcctgaatgcagggagaataaatccccagtggcatcaaatagagacctaaaaggataagaagaaagggtaatccaacaggcacttgtagacctgaaaaatttgaaaggaaggggaagtgggggaaaaagagataaagagggatggaaaatcatcccaagcaaagcagcagtctgagtaaacccacagtccatgggtttcattgactgtgtactggctaatttactttctatttctgtgacatttccacttacttccagggatttggatataaaagtatagaactgtacaaatatagggcattattattaaggcaactttactggaactggaaattgacagagggctcaactgtacaggggacagatggggaagaaaaggaaggagaagggatgtcaaggagcagcttctcaggaggaggaggagcttggctgattctaagaaagccccagagcctgtaaagatcatcctaaaacatctgtatatttaaggcagtacagtatagtggaaagggcactaattggcagaaatctgggtttaaagccaagttctgccacttcctaattgtgtgactaaggacaacttaacctctctgaatcttcattttcttctgtaaaatggggctgtcctgctgcttatatcaaccttataggttgttatgacagtgttgactcataatagttactctataaatattaatcatttgcttccccctctttccttccctccctctccctctagtacatacacacacattcacatacagagcctgtacacaatgcctgcgataaccagccattccccaagacttactattttagacctctgggaattttacccatttgtacattttcaagttaccacctttgctttagtgactttcaaatctcagtctccagctctaacctcttaaccttgtgattacattacattgcttgagtctttttttctcagaatgtgtcatcctgtatcttctcattctaactaaaatttagaaagtgaaaaagaaaagagttcattattgtcccctttaagcccttgccccagaaatactttctaaaatttaccctccacacacaagcatatatatataaacacacaatggcagcactatctatgcagtctttctcttgcctgcatacccccacaggtcagaaagcaaatacctcttacttaaaaaggaggaaaaaggagacccagagagaagaaggtcctattggtttatccatagagtggtgaaagatacttccattctcaaaacagtttagtgtacagatccagttcttttgattccattacactgggacaaacaatgaagaggaaaccagtgacagagacagacatttaaccttctgctgtaagtcctcaggtatgacatggtctcacaggggactgctttgagttacttggatgtaagcagaaatctctggacctagtattagttgaaactactaatatttgccgggcgcagtggctcacgcctgtaatcccagcactttgggaggctgaggcaggcggatcacgaggttaagagattgagaccatcctggccaacatggtaaaaccccatctctattaaaaatacaaccaggcgtggtggtgcatgcctgtaatcccagctacttgggaggctgaggctggagaatcgcttgaacccaggaggcggaggttgtagtgagccgagattgtgccactgcactccagcctggcaatggagcaagactctgtctcaaaaaacacaaacaaacaaacaaacaaaaaaagaaactactaatatttgaatataaatggaaagaactgtgacttgtaccagcactttggtcaagtaaaattaaaacagcctctactgcgtcacccaccatccatcttcagacagtcaatgtataataatgtagagaaagatcttatttttccaaaaaaagaatccctctttagaagaaggtctgtttggccacagaaatactatgacaggccattggccactataacagggtagtgagtgaaagcacaggagcatgcctgagtaacaagctaaatgaatttcaacgaggcataggggtggctagttcccaagcttctgttttcctgagtggagtatgcaagctaaagccagagctgaagaaataggcagggttctgccctatgtgacataccttctctttccaaacatgccacgtagaaggccacaggccagaaaaggataaccatcacagttatgctgaccaggtgcacgtagggagcaaagatctgtgagaaagccaaaagtcaggctggatacatctagacagctagtgctggagctataggatgatgcttacctgcattgacagcccagctaccagccacctttctttccagaatttgcatataatgaacattaaaatgacacacagaagaatcactagcagaatcaggatctagggaaacagaaaaaaaatctcctgacttcaagcactaggcttggatcagaactgtcctcaggaattatatgtgtgtcttcacaatgtcagggaccttatctgcttcctcattcttttaccataataatgtagagaaagatcttgtttttcctgcaaatccccagtattagatggaactaatcattcaccttctttgcttctaagtctttgctgtacagcatggctggaaaaaattacacagctaatttaccattactaatttactatctccagcctcagctgggtcctcaacattgcttggtatctcttactcagattcaacagttgccattaaattcttcaccatttctttagtcctcaattgtatactcaatacaattataagtaaataatactctgtaattgccttttcaacgtccgttttccccaacagactataagcttcatgaagtcaaggttaatattggtattttttatgattacatcctcagtgtcctgcagaatgcctggcacatagtaagcatccaataagtatttattaaacagatgaaaaaacctgcctgccagaacactgtatacttcatagagaaagaacattgagaccaagaagacctaattttcctaacttcctccctttcaaatgtatagttttcctacatccgtgctgccctctagacagtacttagctctcctttccataatctctacatctaaaataactgaatccataattaagtctttcacaactctttgctgacttcaatgataaattctaccaaacatttaaggaagaaatatttccaatctttaacaaactctttcagagaatagaaaaagagagaatactttataacatcttaagagtgcaacaaaacattatacccaaatttaacaaggacattattacaagaacagaaaatacatacatagatgaaaaagttttaaacaacctattaggaaaaactaaatgcatcacaacacaaaagttgaattgccagagtcataagaatcacagatcttacccaacaccaaacttcactatggatttaaaggatacaggcaatcatagagaacagataaaagattttccagtggcaggctgggagcagcggctcccatctatgatcccagcactttgggaggctgaggagggtggatcacctgaggccaggagttcgagataagcctggccaatatggtgaaaccccatctctactaaaaatacaaaaattagccaggtgtggttgcacacaactgtagttccagctactcgggaggctgaagtgggagaatcgcttgaacccgggaggcagaagttgcagtgagctgagattgcaccactgcactccagcctgagcaacggagtgagactctgcctcaaaaaaaaaaaaaaatttttttttgagtgaatatgatcacgtcaaatgcagttactcatatagggtctttcctctcccgtattagtatacattctgtttttggacttaaaatgtaaggtgtgttttgagcaaaatatgaagaaacattgcttcacaggcgtcattttggttttttatggagcatcattattttatattccattaattatataactctagccagtcaatatcttttaacacatgaacctatatattccaggtttgtttacaataaaaccaacctaaatatatctaggtatatcctgctagaaatttttgcagataagcagctgacaaatacatttcgtgtgtttaccaggaggtcaggttattagcatgtttacaaggagtttgggttgatgccatttgcttctctctgggcatctgtaggtagaaggggaaggggttctaggcctcgtgctaatgcttttcttcctaaatttattctgagtacaataaaatgaaactccaagccccacaaaatctcccttgccaataaaatcagtctctcctcacaagtctgataagcctggtccttcctggtttgaagacctgaagactcaaccaaggtagttaacttccaagggaatgccaactcttaacaatcaccctgcacttttcattgccttcagactctgtgaactagatcccagaatgcctcagaagatgaaggcttagaaaacaagattttactaacaaatattggcaaaaatcctgtagaatatgtgtgggaatgaattctaagggtgctagacaaggaaaagagaacataattttagaccagactaaatttattgatatgggtgcacttaccagagattctggatttaatatcctagaattcaggtattaagcagttcaaagaggttctgattgtttggttatctgaagcctaggctcattggtagcctatgctcaatgaaattgggatgccagtaatttcttagtataatatagaagaaataataaaagatttattaagaaaaggtgctggaacggtatcacctatgatcagctaacctactccctatatcgtgttctctgggaggtctcagaagacgctggtgaggaaagtgtcagcatccttgaaaagcactgtggtggccatcctgtatgcctgaaaaaaggtgagagatgctgccactcaaacagtcttcctgatttcaaaggggatgatgtgcttctgctgtggcagaggccaagtagcagtacttaactggcacaggcaacataagcatagtttttataatagacactaacctggaatggtaatcagaatgttttcagggattcttggtattggttaatttatcatggtgtcccaactccaaaacagatgttggatatcaataaggcctatttgttcaattttcaaatctatattctttccctagaaaaaatctcatggcttcaagctccatctattctaataactctaaatttatatttccagttcatacttctcatttgaataagaggatattgataaggcttggacctgtgttccctccaaatcttatgttgaaatgtgaccaccaatactggaggtgggcatagtgggaggtgtttggatcatggggacagctccctcatgaatggcttagtgctgtccttgcagtaatgagtgggttctcattctgtgagttcacatgagatctggttgtttaaaagggcctggcacctcctccttctctctcttgctccctttcttgctatgtgatatgctggctccccacttgccttccaccgtgattgtatgcttcctgaggccctcaccaggaccagatgccagtgctatacttcctttacagcctgcagaaccatgagacaaaatagacctcttttctttataaattacccaatctcaggtattcctttattagcaatgcaaattgactgatttaagacttaaggggaccactcaagagtttgaaatgtttctggatttggggaaatacaagaaatacaagaaatggtatcaacactatgcctgatgttctcactcatatttgggaggtaaaaaagttgatctcatggaagtagagaatagagtgatagttaccaagggctggaaagggtgggtcagagtgggagaaatgaagaggggttggttaatgagaacataccattagataaagagtaagttctaatgtttgacagtacagtaaggtgactacagttagcaataatttataatataaaatagcttcaaaatagttcaaaaaatagtttcaaaacagctagaagagttgaaatgttcctaacatgaagaaatgataaatgcttgagatgatggatatcctaaattccctgatttgagcattatgcattgtaggcatatatcaaaatcatcacatggatcccacaaatatgtctaattactatgtatcaatttttaaaaaccatgcccaaaaaagtctataaaaaagcaagaggctgtcactggagctgctcaagcccatgggagaacaaaacaaggatgctatattggaaatatgctgcatgcctgcagatggtggggcaaagctgactgtcctctggggaccagatatagaccctgtgaaagaaatcatgctggtgttattttaaagatatccaaacccaagacggggtaaaaaggacttcaaaaaagaaatttcagggggctacaggaagacaggcattgactccaccaagagagttatagtcaaggttctcagtaggatttctgaaaacacacatagaaaacgtccacgggaaaacaagcaactgtacatttacctagaaatgaacccctgattccctttctcccctctccttgtgagactgtgctcgtttctccatctcctcttcccctggaccccactcaggcggaaaagaggtagaaggaccaccatgccctctctgccgctatgggcttcaggcttggataaggcccaaataggggaggggaaacattttaaggttaataaagttggagcttaggttattacagtgaactgaaatttttaatcactgaaatgagagtattcttgtgactgaaaagtactgggaaattaatggaatgagtgcctaagattttactggaatgggaagaacagggctacagattgagtttaataggaagtagtgagaacaaataagagtttgggttcagctcgggttcagctccctccataaatcagttgcaacgttagaaatttaattatttcagttaatatggtgtaagtaaatctcttctctccaaggagaacagtaacagagagggtaaccccatacacaaaactgagtaccaaggagcatgttcaggcctggtctaaggttcagtcctggtctaaggtttcctatgtggactcagatgtcctaccttatgacacaagtgcaggtatagttcaatcctttcccaaagcaacaaaaatccaagtaactgcaaaagcaaagaagaaaaagagagttattttgaaatcaccaagttgccacccaaagcactgttcctatagctccaaattccgttcacagtctagcagtacactcatttcttgctatacctgtactttatttagcctctgggagttttccatgttgtttgcctgaaaaagctccctctccctatgccactgactcttcaaagccagttcaaatctcacctcctatttataactttcacccgcaacctcaggaagaattctgtgttatctcctctaagatttcataacaattaccacactgatactcagttgagttcctgcccatttcttttccctgtgaggaaccttattcatggtattacttggactcacttgtaagagaagaaaggtcaggaggcagcccttccaaggactcttgttttggggaaccagggctgttgttacaattgtcaaccactgttgttaacactggtatagattcaacaaatcttggattttaatctaaatctagccagtcaccaagtcagtgtaaagacagaaattgagaactggagtcctcagatgcctaggatattaatgataatttgatgtgtaaggcacttacctctttatcaaaataatttcatgtgtatttcatttgttctttacttaaccctatattataccattttattaaatattatcattcttatttgaaaaaaaaatgaaactgaggtcagaagagttacatgccttgaccaaggttacatagtacctaaagatagaactagaaatagaatccaggtccccctcctttttcactattgttgccattgcatgtatccaaaaagaagtagggtagagtagaaagtttgttaaaatatattgctttattggacacctgaattcattcccaccttagaacctaactataccatttcatgtttattgtgcataaaagtggtacaattcagtggtcagagtttgccctacagcacatccttcatctacattttccccatgtaaaaaaaaaaaaaaagtttctaattggtctctctgcccatagccaccctccaaaccacaacatcaagaataattttcctaaaatagaaaactgatttatatcaaatgtcttagcctttctttccaggccttccaaaatctcacaaacctcttttcagccatgtttcctttttttttttttttttttttttttttgagacagagtctcgctctgtcgtccaggctggagtgcagtgtggctcgatctcggctcagtgcaagctccgcctcccaggttcacgccattctcctgcctcagcctcccgagtagctgggactatgggcgcccgccaccacgcctggctaatttttttttatatttttagtagagacggggtttatcattttttattgtgtctatttgattcttctctcttttcttctttattagtcttgctagcggtctatcaattttgttgatcttttcaaaaaaccagctcctttttgaagggttttttgtgtctctatctccttcagttctgctctgatcttagttatttcttgccttctgctagcttttgaatgtgtttgctcttgcttctctagttcttttaattgtgatgttaggatgtcaattttagatctttcctgctttctcttgtggacatttagtgctataaatttccctctacacactgctttaaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgacagacagtttgttatcatttctgttcttttacatttgctgaggagtgctttacttctaaccatgttagccaggatggtctcgatctcctgaccttatgatccacccgcctcggcctcccaaagtgctgggattacaggcatgagccacagtgcctggccccccattattcttcattatgccctacatactaacagaactgaccgttccctctcagcaagacagcctatatttttctgtcttgcttagtcatgaagctccctcagtccacaatgttcttcctcattaccatatctatatgtccaaatctaacattcctttaagatcccactacagtgacaaggaatagttataacttatatctcacatctacctctatgaagtgcactgcatgaaaacagaaattgcttagcttttattgatcttcgtatactcagcacttctcacaacgttctgctcatataatgattaataagttttgttgaaagaaaaagttcatgcaaatagcaacatatttgggggctaggttcttctgtatcagacaagaattcaatagagaaaggaatggtgaaatcagagaaagttatctgccctatgtataaatgggcactgcaaaactctgtctaaagttatcctcccatttccagacttttctcttacctggcataaatttctcacactaagtgacactactatgttaggcaacagaagcaaggtcacactattgccaaaggcttttgctaaaatgtactttgcatctgggctaggtgactagcatttgtacattagaacaaatttaacaagtaagcaaatttttttaagacccagaaagactgattttcagaagatgggacatgagatgagtaaagatactgctgctgtgaagctatgggtatctaaaatgacaatattgagggaaccataggatagggtatgaaacaaggaaatagaaaaaggatgttgttacactttcaaagggccaaactggcaagacacatcctctaacagaacaggctttccttccacgtccttccacgtcctattccttgtgcctaaaattcaactagctaatgtaaatcccaactctactaagacaagagtgatcttaggttctgagagtccccagtaccaactggatactataccacaggcaggaacacctcatcaggctactcaggaagggagtggaagaaatgagaagcattactcaccaacagcaatgaagagtaggcagtcaggatcctagctaaactcagaataaaaatagaccagaaaaaccagtatcctgttcctagaaaagtgaccctgaaaaaaaatgtgtttcagttcttaaaataatgcagaaatcagtagcatctgtgtcaaggatggggacaaaaccagactagataaggcataagcaaatgtagggagataaaaagaagcagtgtgtgaacagcagcttttgcggataattatatgaggagttttaaagttgtgttctgtaggcaattggggatgttcatggggtctgtaaacgcagtaggatcttaagttacttagaatacatatttaaaaattacgtcctcttttaaaaattaacataacacagaaatttgggaataccggaagagaaacaatacatcccataagtttactgcctgaacaaaactaatactttacactttggcaggctccttgtccacatgcatatgtatttttggacataattgcaatcacagccaccatattaaaaaaaaagccccaatttttctgttcctaatgtagcatatgagagaaaattgttaatgatttgttaggagaaacaatgttatacttgatctaggtattacacaaagaaatttgaatcttcatctcaagaaaacagaaatttcctcctctccgtacaaaacctggagaaattaaattttttaagaattaaactataggttagtgaacatataactacactagtaagaattataaaggaaattctcttggacaagagctgtgagataaactaggaagaaacaaacaggcaaagagccttaactagcaaaaggtatcccagatcaagactgggaagagtgctctgtagaagatgagctcacaatcaggaatcagaaaatatgtaagggatgtcaacaaatgaaccctatgagccaacaaatagaaaaacttggacccaaaaaaacataattaatagaatcagaaaagagccacaaaataaatatatttaagatcttccatgatgtaaaggaatgattcacatccatgaaacaagaataggatgttttaacccaagcacaggtggttattaaacagagatcttgaaaaaaaattttcgaaattaaaaaaaaaaacatgaaatctggccttaatagcactctagatgtagtcaaagaactaatcagtttaaccaaattgtgatattgactttgctttccaagtaacaaagaaaacttagtgtttgtcatttcatggtactcctctttcttctaatcattttactggtcacattgatattttattttaatccctttctacctaaaaggttttcttttggatatcagatcacatgtaaatattactattagtttgctttacttcaaagccctctcaccaaactcaagtgaagttcccaccccccagctatggattacaggcaaaagaagaactgtgatttggctttttctctctctccctctacttcttcccatccgggtaagtaactgtacttactgttggtgatggtagtggcgtgaaaaaagggagtgaaaagagcgagaaggagtttgcttatgtgactgcctgaacatcagtgggaactgaaaaaggaagtctcctttcttggccgtcacttctttaagctgagaatatacaatgctgatgactatgcagaagtcctactctatgtgaatgtgtccaatttaggcttcttctgacttagtatttttaagcagttttctctccgctctggaccattgtgttacatccctctagcagcataatcacacctccattttggatgtaggcctactcactcaaccaagacagctttactggggcagcctagtcaatgcaacctactcatgtaaaatccatattttctgttatcattataacaatgtttaaagaaaccttcaaggaccccttccctcctttctcacagctgtaagatgcagctttcttgcacctttccccaatacatattgcaatgttttatatcagcatcaccaactgtcagctgacagtaactctagatgagaaaaaaagataccatcgatggtggaggccctaggaaccctcgcacagtttgaaatggagaaacaacacacacagaggggaaaagagagagttacggttaccctaccaaaaaattctgctctttctagctaaggggaacaactagaaaagctagacaaaatgttttgaaaaatctaaatgaaagcatcagatatctaccagacagtgaagaactatgaagccaagatctaaataaggaaggaaatccagtgatagtgtagcatttggggtaatttttctctagaaggattggctgaggtacaggaagctcttgtaaacttcacagggctacaggggagaaggtaatctcgtaaacacaacacactttgatttggaaccttacagggttacattctaggagtaagcacaaacttttccagtttgtgacttgtgggggaaggaatcctagctttgaagcatctaaatgtgtgaacagacgttattagtctgctccccctaggtactggcttgatggcgtacacagcttaggcctctccctaacagtcctcttctacggcacacgtaggggttattttttatacagggaaaaaaagattctagatgaaagatcagaggtgcatgataaaatgaagagcaataaaaaaaagtaaatatgtaggtaaatctaaaagaatattaactatacaaaacaacaataatgtcgtatgtggttggaaaagtatgtaggattaaaatatatgatgagaatggcttataactcagaagttataagtgtctgaagaagttataagtatatgaagttaaggtgtttcaagatccttgtattatccaggaaaaggtgaaaatactaatataagacttcggtaagtcaagattacatgttgtaatttccagggtaggtacaaaaaagacagcaagagtgagtaggagagaaaatatgggtattccttccaatttaatagagggaaaaaatgaagtaataaaaaatacttaatataaaataaggcaagaaaagaggaaaaaagaacacagggctgggtgcggtagctcacacctgcaatcccagcaatttgggaggtcgagcgggcagatcacttgagctcaggagtttgagaccagcctgggcaacatggcgaaacctgtctccacaaaaaaatataaaaattagctaggtgtggtggtttgtgtctgtagtcctagctacttgggaggctgaagtgggaggatcggtcaagcttgggaggcagaggctgcaatgagccaagcttgggaggcagaggctgcaatgagccaagatcatcatatcactgcactccagcctgggcaacagagtgagaccctgcctcaaaaaaaaacaacaacaacaacaaaaaaaaaaacacagaactgataggacagtagcattaggaagaatatggatgtaagctcaaataaaatatattagtgatatattagtacagagctattttttatttggaacataaagacaaatattgccaaactggatttgagaaacccaaccatatgctatttataagagaaacttccaaaacatgagctacagaaaggttaaaaaaataaaggatggaaaagataaaccatgcaaagctagtatagctatattagttattatacaaaatagtcttcaagttaaaaacatatgaagaaaatgaaagactatgctgcaactttgcactaagattgaagacttcattggtactgagacttgtgcctgatttacaacactacatcctggcagacgaagatcacaaatgggggatggctgcaaggatgatcatggaagctagccagtaagcatctcagtcttgggaacaatggttagggttccaagccatgccggtggtcagtgcaaaagcctgttgtgagggatatttctgtaaaatgcctggaagagcaattccaaaaagtagctagggaccagtgcttgactgaggcactgtctaatgaaagtaatatgaccagagtgaccagtgtcattttgatgaccagagtttcttcttaccaccaccacgctatttttgctgtcttgtggtaagccccaggactttgataccactcaagggatggggagagaggcagaaagatttggatattagactttgcataaaccttatcaactatggatctcagagctggtattttaaaatttataaatataaataaataaattataccatagcatttatattttaaattgaaatacaattcctgtggaataattcagaactggcccataaatgaaactgcagatgaaccagtgagaaggctaactgaaaacccccaatgaataagtaggcaaaggaaaataaattttaaaagaaattagttaaataaacttgttctgaaactaaatgattcaaattaaaacaaaaaatttcatcaagaaaacattatgcaatattacaatatttaatgctgtcatatacctctgttttaaatagaaattgctataaccttttgagaaagtactttggcaacagacataatgaattttttttttttttttttttttgagtcagggtctggctctgtcacccaggctggaatgcagtggcacgatctcggctcactgcaacctctgcctcccaggcccaagggatcctcccacctcagccttctaagtagctgggactacaagcacacaccaccatgcctggctaattttggggcataatgaattttaacaacgtttattcttcttgactcaataatgccacttatgggaatctattctaggaacattagtcagaatacaaagatttatctgcattactagtttataaaaacaagaaaattggacacacatataatgcctaacaattaaaaatggctaagtgtattatagcatctgtcatgaaatatttttaaaccattttaaatgatgttcattaggagtttaaaaattttgttaaaatgtttattattttaagtgaaaagagaaagcaaaattatgtatacaatatgagcataatataaaaataaacatagaaaaatataacaagtgattatctctcaagagtgagactaggcagatactatattttctaactttttgcattttacacataaaataacaaaccatgttttacttctacaaagaaaacaacaactgtattccatttttaaaagccccatatccgaacagatccttctcccccaaataccaaataacaagatttgcaggaaggttagaagacatcaagccagaaaagggctgggaacattccagagtaggagtttagccatgaaaagggtactggaaagggatacctgtcactgtgttcagaatcgtaggaagcctcctaagaacagcagggagaggaagagggtataggagcagcagagaaggcagggttcagggatagagatcatgaagaccaactagtgtcaacatcagtaactcaaagagactaaagaaaagataccagggaatcattatctgagtagaaggactgtggatattggaagcatgaaagcttcctactgagccagatttagtctaagtatgagactgagcacagtggaagaaagtacaataggttagggtgctaagcatcctacccctgccccagaggcaggcctctcacccaaaagctgtggaaagcccagttttgtccgccttccctactatatcaccggatcttttcagcctgaggtagaatccaggtggctatcagaccaaaatacccttacacaaatgaaactacaaaaagtgaaactcaccagtcaaagttaaagtattcactggatgtttctatccacaggaacagcaacatcagagacaagacaaatgaaattaccaggcacggcaaaataattgctctttctgggaaaagaaaaaagaaatctaacttagctccatttatccttgttacctcagcagtttctgtatacacttgccaaaggtcagcatagttgcactgccatgcattaccctcctgaggctggagtgatcactctcttctttttacccctaccaaatcctgtatatgcctatttacaacctttcttacacttaactggaattatgcatttatgttttatctgatgctacactgtttcttctttgaggaaaaggaacgtctctgtattaccaatacatagcattgtttcttgaatgcagctggctctcaacaatcatctgttgaattcatctgcctctccagctatcaaatgttttgttcagcaattaatttattgattcattcatcattaattggttcatttagtcatcaatctaccccattggagaagaaagggggaatcagagttaaagaataattttttttaagtagctattttgttctagtaaaatgctagggaatttcacaagctactttcatttgatttatttctcattagagccatatgagttgggcatcaacctcatttttgcagaagaaagctcagagaggtaaaataattgattcaagatcacacagctaagaagtggcaggggcaggactagaacccagatctgtgtaagctcaaagccaaaatggaggttatcattatggagaaggtactgctttctctgaaggcaaagaagtctccctgtgttagttttgtccttttcaatacgtcctccacacaatcaaataatcattccaaaacacagctcagactacttcatcagcttaaagtctttggggattctttattcccaacatggcagaagtcaaattcttaaaaccacacaacattggacccatctccctctctagcttcttttcccctcacttcttcacattcatatcctctccttcatctaaaataaaccttgtatcagtctccaaactcattatgccctttgactactcctccaataccaattcttccaccatccccaattctctacctatccaattcttaatcacccatcaccttctaaaaggtggccctccccttggtatgtgcctgtgtacatgcgcatacagttacagcacttctctcactatattgagattgtgtgtgtacttatctttccccacagtagactgaattccttgagagcaggaaccatgcctgaagcacttgtattatccccagtgactagcatagaggccgaatatctgggcaggaaagatacagtggggacagaagaacattccttcctactgcagggaaacctcccatttcctacccctttccttgtgttccccacctcaggtataagaaattaatgacccaactggtctgattctgggaccctagttggaccatgtttacaaataagtaaaggtacatgattttgctcttctgttctcatttcagtgtgctgatcatttaatcacttataccatgtagctcaccaaagggttccaacatatggcttacaaatagaggccctaaaaaaggctagtccacgtgccaccactcagccttactagagttcttcctcagggaaaatcaccactagcttgaccaataataaaggagcaccttgtttctcacttgctgtttttttctcctgcgaagagaaattcacagaggagagcaaattacaattcaggcatccctgtaatccgtaaccaaaaatatctaattgcacccaaacatcactttttcttcaagattcactgaatgaataaatgcaaaagtgaattaatgaataaacataaaagaggtagtaaggaaaagtaaagaataaaagtgaaaaatgaagtgaaggaaagaaaatgaagaaagcaagtacatgtttcagtaagtttaacattggtgcaatacttttatggaagaaatggagccctagcatccccagtcctggagaccataaagagccctcatggggcccagcagtcagcctatgctccccgcatctgagaaaatgtggtccagctccttatcagtctgtacccaagtgcagcaacaaaatccaactttagttttttcccattgtctgaatttccagaggcaactatagcagccagtaaggaaggtgacaaagcatttgtggttgaagatgcgtggaatccatggattaagcttttttggtttttctgtcttattcctcttgtgctcaatcctgttgaccttcttaaacatgattcacccttt

SEQ ID NO: 294 - DNA, 245538 bp, Homo sapiens
  source 1..245538: mol_type = genomic DNA
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaaggtaaaaatcttctcccctccttctacgtggtggaaaccctgagctgcaccggccagggcagtcgtgctgggctcctcagagcaggctgttgcagttgctctgttcgcaggaaattatttggggcgagagggaaagagatgcagctcgcggtggctgctgtaccctttagcgtaaccttgctactcccccccaccgccgagcccctgccggctcctcggcccccacccccttgctttttgacaatgaaatgccggtcacaattggtcagagcaacccggattgtctccagaaccgtaaaacacccccgtaattagtgcgcttaaaaaaaaaaaaaacaaaaaacaaaaaaaaaaaacctgctccctattcctacacccaacatgtgactgaaatataacttttgttcccgaggggtggtcgtcttagaaaaaaagttgttcagtttccactgcgatagaatctttttatttttttaaaggactctctgggtctgatcagacaggatttttttccccctcgtctgattgtaattgcaagcgctgtcggagagacagtcctggtgtcagcttttcctaggcattgcacaatgaatttttttttaaaaccaaggtgaataaagttgctgaatagttattttactccgatccatatgaaagttgagcaatcccaaagtagaaaactcctgtgatggagggagaggaagaactaagcaaccaggcaaaatgaccttctgtgtttgacagtgcagagaggctatctaagcagcactctgtaaatgcagggcggtagatgtttgtaaacacactgctgggctacccagtagttgtgtgtatgcatgtctatatatctgtaaagactgtggtgctgcggtttgttgcttctaaaaagttgttgtaaagtttgccaccattgggaggcaggatgatttatccatctacccgtgttatttttcccatcgctgcatttattgtacactttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcagaaaagatattcatgggtttgaggataggctaatgtgaaatcaaaaggtggtttgggcttctttgtttttgcctcacaaaaatgcctaatggaacttttaggcttttgtgtttgtacataactggaggtagcagtatgtatgtctgtgggcatggggcgtgccacactaaagaacttagggtactttgatattaatacttcaaaaccagtttcttttgcggtataaattagattctacacagagttcaggaaaatcctgcggtatagataatctaatttatttgacgcttcataacatagaggtaactaaatagtaggatattcaataaataaattgtatttggctcagtggcaataaacccgacatcaggaaaatctgccaactacagatcagtaactttagggcaaaaacaacaaaaaacaatgctttctgtgacgtttcttgatcctcttctatactgcatccccaccgttttgatgggcttatggtggtgtgctggctgcagactgctactgagtggtttgtttcattgtgctccagtcggaaaaagagtacaacagtcccttgccttactcacatacagaaccaatcccaagcaaaacgcgttcttaaatgcaacatgaaaattgtctgtaatttgcatatcatttttttccttattgcttacaactcagttctttcagggtgcctcttttcattactgtgtacttctatgtaattaaaatagatttaatgttctttaccagaaaggaaagaatcacttttattttggatcgttctttatggaacgagtatgtatttgcttagactgcatgtgtctaggtgaacgtatgtgaagagtatctttccatggagtttgtttaattcagtgttccaataataagcactagagatcaaggactgggattattccaggtcatctgaaatgttctggtgatgtgtgctgcgtttcatttagtccttgggatgtggtacggtgactgcataataaaaaatgtttgctggtaacccacaagcaagttgcttgcttctagagtccagtaaacaatatgcttttctgtgtagtgaagaacgaatgtcagaggttttcaaggatgagctgatgaacctgatataccgaactcctgtgacacaaaaggctctcactgtggagaggtttttcccagtcctcctctccactcctgaaaccgtcctcacttgctttcattccttacaagtagcgggtcagcaggcagacagttcctcagcggctggtgagatgcagccacagagggaagtactttgtttatttctgagcagtgcctgctctgctagaaaagagtagtgtccgatttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgacttgcagaaagcaggagtgctcgagcactcctgggggggtctgtcctacaacccttgaaggttgtggcactgttgtcatggaagttcaaatgcttcaattcctgaccatttggggtcgtttaaatggaaggaaaggatcaactctctataaaaagtcaaattgttttaaagaggattgcctggctgactgtgctggtcacaggaagaaggaagaggctgtcttttccatcatcagccttcaccttcaagtcacctcttcagttctaagtttgaccaagttgcagcggaaggtggttgtggcctagcagacacggtcccttgtcaggcttggcacagcttgttagtgggccaggactaaccagaatccaaaaacgagtcacacagtgtctctagtcccctccttccctgctgtccgtatcagtcagctttcatagcagaaggaaatctggtttttaaaattttgctactaactgggagactctttcgagctccccttctggactctgggctccttgggtttagtgatgattatcttggtgtcctagtagttagcttggcagctggcatagaaatatttctcagtaatgtttgctgatgtgaatgaagtgagaggtgggaggaggccagccccctttcctctttctgtctgcgtgtaacctcagggtgacgtaacactttcatccactggcttgcttgcagaaagcactcaatagggcccactacagccttagagagggctagagcactcctggggggtctgtcctcaaatgcttattaatagaattttgatacaataatgttttataatttttttttggagacagagtctcgctctgtcgccagactggagttcagtggtgcgatcttggctcactgcaacctctacctcctaggttcaagcaattctcctgcctcagcctcccaagtagttgggattacaggtgcccgccaccatgcccggctaatttttgtgcttttggtagagatgggggtttcaccatgttggcaaggctggtcttgaactcctgacctcaagtgatctgcccgcctcagcctcccagagtgctgagattacaggtgtgagccactgcgtccagcgtaatgttttattattttgataaaattctcaaaaactgcttttgtgtcaaaaataacaaagaaggaaattgaggaaaaggtacaacaaaggggcttaaggaattgctttaacaggttcagattagcaggcttctaagtgccccccagtttttctgacaatagaatcagggaactttcaaacattcagagttgagagaccttagagatcccctgggccaacctcctctattttttacagggaggggatccagagagctaaggggtttgcttcaacccatgggtgagtgagccaggtttggaggacacaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtctggtcaggtgtgagaagaggaagtagtaggagggaggagatgagagaagaagggcctgacggacttgtattggcaccactatttgcatcaatatatgtatatatatatatcttttacagtgcacaaaggcctgcaagttctgttttgggctgaaggccccctatctgctgttaggactcctttgaggaatccttgggtgggccgtaggctcttttatcaagggtcagacaatcctatttatactttaatttctgtgtagtaagctccctgtttcaaacagtcaaagctaaaaatgtggcagctggccctagagaagtagctatcctgctcaggataagtaagtcaagggcaaaaaataccccagatgtgagcaccagaggcaggtagagctaagtcacattctgctcctctgagtgcagctgtatttgtgcacaccaggaaagagctgggggcaaggtgggggcacagggttgctgagagtaactcacacagcagtttcatttttttcaccaatttttaaaacttgccctttggtgtggatctcccagccaagtgattcagtgtcagatgaagccccgtaaggtgtgccatatagaaatgacatgtttgttctatgtgaatactactttagagacaatcctggagcttgttttcaggtaagggtccaccacttccatatttgttgttagatgtgtgttgggaaccaatctccgtgtgtatttgttgaatagaatgagtgtgcatttactcagggttcccacgccaaaagggacccagcttaaagactgttcactgccaaacctagtatttggggacagaaagactagactaaattagtaaaaagttagaattatagcctattaaaaaacaaacacatttttattgattttccaaacatacaggaaccaaactaataaagtgttgcttactggggcatctcagggaacgttccaatgaataggcaagaatgtgttccacattatccattgggtagaaactagtgctacgatgtgcttggaactgttcctttagtgtcaaaatattaccacacattttatttgctctgttaatttgtttgataaccttttcttcttagtaaaaatacagagttcagcctggtcgttgtctaaatgatctggaattcccagagtgtggacgaggggcttgattagaaaaggtattgccccgtgttaagtgtggactctcagatgagcataactgctcactcagccctatggatttcgcttacaggaaacggtagaatgcttgcatttctgaaactttgtaaattctctgtaattaaaggtgttcgtctgctgttttagtggccgttgttctacaacaaccagttgtagcttacagctatatagtgatttattacaaaacactttcttcttctccttttccttcttcctcttcctcctcctcttcttcttcctcctccatcatcatcaccggcatcatttattgaatgctactgcatgctggtccttgtgctgttttatatacattatatacattatctcatttactcttcacagctctctatggatgcagtttttctctccattctacaaatgaggaaactgaagcccagagaggttaagtgatgtattggcctaagacctcgcaggctgtaagtggcaaagctaaggccagaatctctactgtgggactctaattccaaagtattttctatgagggcattccaaagtgcagccatttttgcgaagaaaattaggaaacttgaagtgacgggtggctggtggattgttacataagccgagatgagaggcaggaatagagctggcagaagtgcttgcagaggttctgaatttcctctgcttcctggtctcttctgaagatgggtcttcctagccattacacaagtagcggggacaaccagatggtcacacaaagccaccacccactgtggaatgaatgtctaagttttccatatttaccccagtctctaatgtcctctggtgaaattttgtctttgatgggtttcattttgggcccttgttgtttttctcagatgcctttcttttccttgtgtttttcttgcttcctccggtgcttaatggcttcttcatgaagcggttggaaatctgagagattgtgtcatcctgcccggcctcgggctagacaccttctttgcctgctttttacttcctggtcagttgcttctccttatacaacttttttttttttccttttaaagcttttcacacaatccataaacacaaatttttgtttttcttaaaccatctctcatgtacatctttaatattatgtgatttccaggaatctatttcagatattccctcattttcccctataacaaaaggaatcatctttttttgactcctgtctcgatggcttgacccaactcgcctgttctaatttcctggaatgaagagagcatttcggccatctgactttatacatttctgattttgaacgactctagtgaagagagtcttcagagcaaatgtagggaaagaaacagagaaagagagagatgtgttgtggagataatatgaggggattcagagagcattatccaaatttgtcatgaagcaaatgaggaaactgagtcttgtggcgtttaaagagcttgcctgagatcacattcctaactgatcaagccagagtcagaatcagtgttccatcctaggtccatgttcctctaacaccatagcagaggaaaaatgagaaaaaacaggcaagaattcagaaagcatagcttccttttgaagattcacatgacatattagtgttcatcattgtgacttccaagtgaaagacagagttcatgttatgagatttaagaagtgaagaaagaatgcaatgtattttggaaagatatctaacaaaaatggttggcataagaataatgttaagttttaaaaggctaagcttcagttacgtggatgaatgatttatgaaaagtactcccccatgaagacacaaaagaggtagccaatgcatctgcaagttcttgaggcctgatggcctccctgggggtattttccctttgtatgtgggagtcagatatacggaaaacgacttcatttcctgaatgacccaaaaaggacgcattgccctgctgagtgccagttggtgagtgtgctcaatggtgttagtgttgccacagtgtagttccagtcaccacgtctttcgattttgacttacattttcttctgtcttatgttgttctttggttcttacctgtaaagctgacttcccttcaggagattgtaaggtgctcagaaaagggctttacctcactgccatgctgtgaattctcctaggggaagagtacagacaatggagtagacagacccatgaatcctggttcctgaacttgaacttgttcaagctacttaatcatgaacctgttaactcatctgaagtggtaataaaaatgtgtctcttagggttgttgggatatgtacattgcccaatgtagtgctttatactgttaaaaagttagttctcctcctcctttatacatcctccataacacatggatctggaagaggctagagattttctggttctgtgcccacattatacagttgagaatacagaggccaggggatggtttgtttttgtttttgtttttgagacagagtctcgctctgtcacccaggctggagtgcaatgccgagatctcagctcactgcaacctctgcctcccaggttcaagcaattctgctgcctcagcctcctgagtagctgggattacagctgtgcaccactcacctggccaatttttgtatttttggtagagacagggtttcaccatggtggccagggtggactcaaactcccgacttcaattgatcctcctgcctcggcctctgaaagtgctgggattacaggcgtgagccactgtccccggcccccggccagggatgttaatggccttgctcaagctcgtgtggctagttggtggtgccatctgaactaaaatctaggcctcccgagtcagctgactccctgcacagtgctcttgtcactgtcccattgagttgttcacagggctggggtcactcagtcagtgctcaaaaaagctcttattttaactttaattgaatacaagcctcaacaataggagagatgagccaagtgcaattatatgataatagcaaatgccttttgcatcttacagcagaattttgaaggaatagctaatgtggttctgaataagtttccagagatgaaagaaaaggaaaaaacctaagtctggaagtactgtacagtgagtctaactagcattattactcagcgctcaagtatttgaacctattcagggatctgctccttcatacagttgcttattatttgtgactggggtgagacttgaaagagagcatcaattctccagtctgcttttgtttaacaggcagttccatgtctgtctgaccacagaacagacactgtttgctgtgggctggtgaatgttcactttcaagagcagggagtagatggcccttcgtggaagtttaattatacagaagagtttgaaaaggccaagtttgttactttggggcatggggaaaccttcctctctagcagatgtgaggggaccgaagtgtctcttttcagcagttgtattcttcttgctgtggacctaaattcgatcctaagtcattctttgtatgtacatggcagatgagaagatgaactatagactggaaaataacccttttttgaggaattgtggagaaaatgttacccacctgtccctcctaccaccatgcaataagtgtgggctacttaatactcttgaagcaagagtttaggtttggagagaaactgctcctctgatcttctcctggaaaccacaagtggaagtttgtgattttcttctcagctgccctgtcccctctcccttgggttatgacaggccgtgtaactttatctttcttaggacttatctctttgatgaggtcagtaatcctgcttcacttacgtcccctatacgtaagattgccataaccaaagatgacatgcagactctaaagcatttcctggaaaaaatgagctacagatagaagtaaggctcgtaatttaaaaaatcgaaccccagagaacagcctgtctctgaagttaaccattcccccagtactttctcttgtttccctggtgaaagtgtgaatctgggttgtggcaggggaagttctggcactgctaagaggtgaggaaggaagagggagggcccagagctgcccacctcacttgcaggtgtggcctggaagagtgccggggtctctaatgaagaatcaagttcaagggatgaagaggagttggcgaaggggcacaaaaatacagctagatagaaggaatgtgttatagtattcattagtataatagggaaattagagttaacaatttattgtgtatttcaaaataactagaagaattgtactgttcctaacacaaaagaaaaatgtttgaggcaatagatatgccagctaccctgatctgatcattacacatctgcacagatatcaaaatgtcacatgtacccccaaaatatgtacaactattatatatcaacaaaaaaaatcaaagagacaatttagaataagtatggtctcaagcctagtgactaatatgtggacaagtagatctgcactagggtatacaggaggaagtattatggagacttcataaaaagggagatggggcggggcgtggtggctcacgcctgtaatcccagcactttgggaggccgaggcgggtgaatcacctgaggtcaggagttcaagaccagcctggccaacatggtgaaaccctgtctctactacaaaaattagccgggtgtggtggtaggtgcctgtaatcccagctactcgggaggctgaggcaggagaatctcttgaacctggaaggtggaggttgcagtcagctgaggttgtgccactacactccagcctgggcgacagagtgagactctgtctcaaaaaaaaaaaaaaaaaagggagatgggggacatggtgggaatttgctaagctcttttgttaactgctttaaagaactcagactagggaaggaaacttctctcaagtttattgctggttgttatttccagaccatttgtctttcccaaactgcccttggccatcaaatcagactcctgctagagtaagcctcatggtagtgtctcttggctcacctctgtggttttgctaattattttcatgtattgacctgggatcacagaccaggcacccaaagggacagaggtgagttctttttctttgggcctctttggatactcataacccaagtccctgtgacaggttttggaaaaatggcacatctgaaggattggatccgtggtgcattttgtaattgctgtatcctcttttctttaaggtcttgctgtgtcacccatgctgaactacagtggcgtgatcatagctcaccgtaacctcaaagtcctgggctcaagtgatcctcctgcctcagcctctggagtagctaggactacaggtgcaccaccttgcctggctacttttttaaaaaactttttgtggagacgaggtcttgctttgttgcccaggttgctctcagaactcctgggctcaagtgatcctcccacctcggcctcccaaactgctaggattataggcatgaaccactgtgcccagccattttgtcctcattttgacttgagatctgggagattttaaagatccgtgtcatgagttcacttgactggtgctttgcacttttgagacccgtcactctcctgactaataggtcttgacggccactaatggccagcaatggctgggaacagcaggacactctcactttgtaccttttgatctggtctttattcaaagtggggtgaacccagtaggagagttgttgttttggggataaagtctgggtgacagattcttcaggctgggtaagtctcctgttctccccgactttgagacctgaatgacctgatttggctgactacacctccagtcccctggacaacagccagctcctttgattttgtgccatttagtccttcccttcatctgctgacgctgatactttcgggtgaggtggaaggagagagcatacctgttggtgaggtaagagtgttttccttcagagaaccaaagaaacaaaggctccctttctgaattttgtgttctgcctctttgcatttctgaggctccttgtgtctggcagggctgtgagtgaggagatgagggtgtgctcctctgcaggcagaagtcagctgtaggtcagatgtggctttggaacacaatggaatccagggggaatgttggcgagcacagcaaggctggggtgatgatcctctaatcttttgcagcgtgctgtaagagtatctttaactttcgccgagacaggcagggcaatgagcaaaaggacctcggtgttaggtaacatctcaagtagggcacctggtagtacacctgtcttgcatgttcccacccttcccaacactttatctttttgaagccatctacccttagaaaatgaacaaggagccactgacatagacagcaagtatatttacttatcttttgggtgcaaggcagtttgccctgctgggagagatgtgggataaggccccagagtggaaaaaaacaaaaaaccttaaaaatgcaagaaggaagaaaggtaggtgagccagcaggtcccactgaaaggccttgttattgcagcaaagagggaagaggtgggcccagtggcacaaatcactaacattcttctgacagtcactagccagttcttctgagaatttctctgtcttgaaaaacttggtaaaatggccaaatggagcttctccgaactagggggaatgcctgtgtgtgcgttcgttgttagccatcatgttgaacagtctgatttaagggaaagttggtctgtgtacattttcatttcagctgtggtctttgaaggttcaccatggaggaggtgtgggtggatgagaatagagtcttctgcctcttggttggcttatatgtaggttataggtgaatgtgagttcacaacccccagcctatttcttatttgggtgcacttttggatgacttgcagggctgagtttgggaaaacccagttactcttcctttatgcacatatttctgccagactaaatgccaaatagataattggaaagaattttcttcgcagccctggtccccaaattggtgtctgtgattcttcctagggtctcatattatgagagtgcactccctttaatcttttgggacctcaagtggggtctgtgtggacaagattgtgcttctttgagaaacttcttgctgcacaccagccagggtaaggcaagagttagtcctgttggctgggtggttcttgggcagttgagcatgcttagcacttgagaggtttctgttataccatttgccaaaagggacatctctccgctggtcctagtgccccagggcacaaatggcaggctttaggagaaaatgcacaatttcaggttcagtctctatctgcatttgtgtgcatgaatggactaataattgcagtgcgttgaacgatttctgcatattccaacacctagaaagtagcttcctggattagggaacggttcctaggtacagctaccaaaggctcaagcttaagcaccaacactggaggttagaattagcacgctctagggaggacagcgagagggcagctgacacaatgcctttatgggctatttttagctttagtcaggcctatctggagtggcttgtgctttcttgggcaccgtcctgcatttattccagggtttgtgcttgtgactctgtttgcatatatgccacatgtatcgcatgctcatgggatgataaattgcagaaattatggcataatctgttttctagcatatagaggaaaagattacacaaaatccagccttgttgtggcgaagaaacctaacatatagatgtaaaatatatctccttggaggcctggctttgtgatgggctatgaacggattgttaaacagcaatgtgaggggctgttagcaagctgtttctaagagcatctccctggtctggtctgaaaaggtgatgtgtacatattgtacatttgagatagtttgcctgtggtgtttatatgttggtaggttgtgtgtgtgtgtgtatgtgtgtgtgtgtgtgtcttgtctgtcttcagtggtgaactgaaaaaataaagtgttgtttacgtgcttctatgttagtgtctacattccaaactgggcaatagttttctttaagctggcttaagtgaagaggtgtttggtcagccacagggtatgaatcaaccaaacttcaaaaagcttcagtgtgtttttgataacactcttaagtatttaatagctgctttaaggatttgtgccttagtgtacttggatgaataggtaaatcacctccccatcagcaaactagcgtttgggttcccacgttggcaaagcagggttcctgttatgtgtctggtcatatttgaacttcttttcacattcaggtgacatagttgaacatcagtccgtgccagtttctgctactattgggtttttaatggaagagaactctttcttgttactacgatgccatgcttctgctgtgttagcagctgctgtattgaaaaacaggtgtctcttataatcctctgactggatcagtttgctagcctggcagagtcttattgttattgtttttatttatttatttttgtcccacataagtcagaaactgccaagagatgttgatgagtgggattagtatgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcctccataccggctgtcactgccttccttctggccccagacctttcagttgtctcctctctgatcttccttcctccattttgtccccacccccaacacaacttggaatgattctttgcagataaaaatgtgatcttgttactctctgtctcacaccacagtaccacagtgtagcatgaaccacagcttcttgtcacctgcaaggccctttactgcctacctttctagtatcatctccacattatgttccaaccacataatgaacttttttctcaggaggacatggtctcgctctgtggccaaggctagagtaatctcagctcactgcaaccactgccttctgggctcaggtgattctcccatctcagcctcccgagtagctgacaccacaggcacgtaccaccacactaggctaatttttgtatttttagtagagacagggtttcaccaggctggtctcaaactcctgggctcaagtgatccgcccaactcggcctcccaaagtgctgggattataggcatgagccactatgcccatcccatgtaacaaacatttatgcctggaatcttccctcgatcttctttctgcctggcagccaatttgtcattggaagtccatttctcaagcctccctgttgctgctgggcacagtgttcccccagcttattgaacttgcttctgttattggcaacaatccagttatccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgagggttgaggaaagaagaaaggtagagacctgtgttttgaaacatatcaggactccatgtcagggcgaacatactgccacctcccatacctaaggggctcctgtgaggcataagtactgacatgtacacacagggcactcacaaatgctctccttctcagttgcctactttctagaggggaatatagatagctggagaagaagcttgagaaccttcaggctggatgtgccagaaacagcagagacagcccaagataaatgaatgtattaactgatcatccttttttttgatgtggctcaggatgcctcttgggtcagggagagagaaccagtggctgtttgttgtagctgtgtgcggtcttggccatagctggctgtggtatctgggacccagtggcaggtcaccaccgtatggggctgccagttgctcccccaccccattcctctaagagctagtagggagagagaacccggaagagcagcacggcttgctgaaacttctctgaggtctgtgattggcctttccatgtcaagggaagaatccctctcttacttgagtcagctctttccagtcttctcttgtacagcccatgttctctcctaccctatctgagatgaagatctctctggagctctcattttactcctaatgggttgcctggagggactaaaccagtgagaatgactgggcatactatgggactagaaaaacaactcaaagttatgtcttacggatggtaggacagcctcaatattgctgtttacagtggatagcccagtgacatttatttaaagagggcagtcttaagagagtgtgttagggttatgaatctgattaagtgtgatctgataagtgggaaatggaccacttgggagaaatcaggttactttcagatataagcagaccaaactgggccttccacacaagcctgaatagctcgttttctccctatttctgttgccattgaggtacagctgggattcagggcattaggatatgtgaaaacttttagcttcctgaacccaaccagaccccagcaagagtccttttacagtttccccgaaaccgtcacaagttttcctgaccgcctgctgggggctttctgttgcagacctacgcggcagctgcctgccagccctgccagatttgacttcatcttggctgccggtgggtcagtctccacgaggcttctcttggcctgtctgtccactcagggcatttaagggtcctcttgctttgctcacatgggctcctcgagggcttgtgcagtaggttgagagttgttacgggtgctgatctggaccacttagggagcagaaagcataggtctgtatatgaatgtgaaaatacacatttaagaagctgctcaggtaggggcagccacggaagttgtgctccctcttaaacactcagcgtacacacctcatcctcagacaatgtgctgcttacatttccagtgtccagcacggtgcctggcacagaggaaggccgatggatagtagttgaacagaatttttttaatcatcaggtctttattaagcttctattatggacttcaagtttcctccatgaatgctaccagaacccttgctcaatgtcttcactgttgaggctgttgagtgagaagccatttccttccccttctacttcccctccctttacagccttaccaggcccagtgttcagaggactcgatgctcatgaacctagggttcctaagaattagcatgtcacaatctaatctggagactatccgccatttagttccatggcggattatggtcttggttctagcaacctgctgaagaacaaacctggtggtttattttcttttttttttttttaaatggggacttgccttgtctcccaggcttgagtacggtggcatgatcatagctcactgcctcgacctcctgggctccagcgatcctcccacctcagcttcccaagtagctgaggctacaggtgtgtgccacgatacctggctaattttttttttttttttttttttttgagatggagtctcactcggccgcccaggctggagtgtagtggcatggtctcggcttactgcagcctccgcctcccaggctcaagcagttccttgcctcggcctcccgtgtagctgggattacaggtgcacgctgccacgcccagctaaattttgtatttttagcagagacagagtttcaccatcttggccaggctggtcttgaactcctgacctcgcgatccacccgcttcggcctcccaaagtgctgggattacagccgtgagccaccacgcccagccaatttttaaattttttgtggagacaaggtctcactatgttgcctggctggtcttgaactcctggactcaagtgatcctccagcctcagcctcccaaattgctgggatcacaggtgtgaaccgccacacccagctgagaacagacttttgaactaccacaactataggtctgttggacattgttttcagttgaaattgcttaaaaattgacctgccttggagaaaatttcatgagccttttcttaaagagtgattgaaatgccaataagaatgcaataacaagtgccctgtgtagatgtgtgggagggacaccctccccttcctccacccagcaaaagctaacgtactttccaaattctaaattgtgatgtgtgacttggtaaaggacttcgcactgttttgttttttttttttaaattgatgtggcaagccttacaaaaggatatgccgttatattctaacaaattatttctatcgaaaagagtatcatgtgagattagggctgtagaggaacagcctttcaactagtcttctatgtggtaaaggtggcacccagtttccaaagacagcacagacgccaagggtcttttctgaacttcttcgatttttatgatccctggctgggtcggagaagggctagttagtatgtttttctttcttctggatgaaagttgcaaggacacttaagccttatgcttcagggcggaatctgatcacaagttgagatcaggaagaaattttccccctgtggcttcctattgcacaattgcccggccaggtgtgctacctctgttaaacaaagacacacacaagtgcacacctccttactggctatcttcagagcaggatgttggacgttgtgggccagcagactggttcctttggcacatccctgtgctcaaagatgggaggcagctgcccgtctgctcctgtacttggctgtcctctgggtgtgctgtactgagctcagggccacgtcttcagatccctacaactctttgcaactcttactttgtgggacaattaaaattaggtctaattctgtacacacccgcatgcacatgcacacatatctttttaaaagttttccttaaacttgcttcccctttcctgggctttgcttcccccttcccgggctttacaccacatcaaacctatatgcattcccaaaacatcaaaatgactgttcacaaatcatagtagaactctttaaccataaggtgcgcagttgccaatctcaagcttggattgtaagcgacttcgaagtctgatccaaaagactgtgggaggagggggaaggaacatggatggacttctttccttcctccctccctccctcctttcctcccgtcctcctgtcctcccttcctcccttcctccctccctccctccctcctttcctcctttcctcccttcctccttcctttcttcctttcttccctttcttttctctcttttctttctttcctttcttctttttgaggcctcggctgtgctgcctcttgtgcaataggataattaccagcgattcccaggctcgcctgcttttctgcctttacatctctatctcctgtggcgcagtacttccttctgcctctattattagcttacttagctttaccattcagttctccacctcctccccgggtccctccccatcttcttccagcctttctttcccttcacctctgtaaaggtattttggggagctaccattcatgttctgttcatacaggaaccctctttttctttattaatataaaataatcttggtcctgcctcattttatcatatattcattcgtattcccaaaatagaaaccgtcgccaccagcacgtaatgtctggcctgtaaacctttaaagtaggatgtgccgaaatgagatcttcacaagcaggtgtgcctcatcccctgacctgcaggcccttcttccccggcggccattcactcatcttcacaccatcttcttgcccttctctctgcttttcgatgattctaccccaatcacattccttcccaaaatgactgtgttagtacttaattgttcacctgggcttgttcatgttgtagttcatcgtttcctttttatctttaaaattttcttgttcttcggggatacactgtattcttgtaattagagattatatcagttttcatggccaaaatttgccacgtggacataatagtatttggtatcaagcacgcctttcaggaagaagggaaaaacagtagattttgggcagcttttgattacaataatttcaaatttctaataactaagaagtacttcatgtgattcttgtagagtaaaagcttaaaaattacccttttctttgtaagtgatatgagtcttacttcgtttgggtaagaaactcagtttgaggctaccaatttttcaaatagtggtcttagaaactaattattgctgtaatttcaataactaaataggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggatcagttttaagaccaggtcagacatacgtacaaattctttctttgtaaatgagaagtggcctttaatagctttcatatggatagatgggtagatgaaatattattctacctaaagcatgacatttcagtaagtactacactttgaaacttgccttgcagggttttaaaaatattcttttctgggttctaatcatttataacgaagagtcactagcattttattaaaacccatattttttggagagggatattaagtgagcagggattgtgggttgttcttgcttttccttaactgtcctgccccaaaaaagtgatgggaataacccaaaccttaaaggttcctggggctttctttttccctagacagggacctcctcctctcccctgctctcatcccacttgttcctgaaaaagggtaaggttggcagggcggggaagagagaaggaaattagggttctagcttaaaactgctgctagagtggctagttctgggagctttttgagagaggcccaaggtggcagccttgtctcttttgcctctttcattaaacctggggtttgctgtacaatgctttgggtctcctgtcccaaaaataaagggctgtggcaagtatcatcctgacaactatccaatcagttctgactgagaggcacttgtaattcagaagatagtcattagatttggatagaaagaaatgagatgtgatgttcagtagatcagtagggtgactatagttcatgttaatcgattgtacattttaaaattgcttaaggagaataatttgaatgtttctagtataaaggaaagagaaatatttaaggcgatggatataccagttaacttgatttgattataaatgtatcaaatcattacatgtaccctgaaaatatgtacatctaatatgtatcaataaaaataaataaattcattagaataacagaatttagacatttagagctatagttttaaggaatttcagaccaaggcccaaagctcggttaagtgacctactgaaggtcccaaggctattattgccatattagaactagaagtcagatctcctgactcccaccagtgtatattgacttttgacccagcagttagttttattttaggctgtattttcgaaataacagattggttcaagtcaaaataatcttattcgtgtgaaaaactcaaccaggtgaactgagtgaatgaacctactttttaattgggtgtttttaggtcatgtgaaaaaaaaaaacacaaatcagaaggtcctttgtgcttcatgtttggatctgatccttttttttttttttaagctgaaaatgaatgaaggatggtagagtaggaactaggatgtacgcataaaacacttgcctgtctgccttgtcacctgcactccagtggggtgtttccagggctcattgtaaggtgagaggtgacttctggacccttgactaccctgttccttctgtcgcaaaatataatcaggaggtttctatttgacaatgtactctgagtattgtaaggaaccaactcccaacccaaatcgaatcgcctctgagatcctattaaacagaaaatgccctgaacaccagtatatgaaaatgctttgctaggatgagctcaaagcatttcatcctccaaataaaatctatctgctcacacttagattgttcaaaggcagatggtaggcaattgaaacagagagacaagctggcaaaaggaaaaataaaaccacaaatatctgcacgtgaaggtgatttacgctcttgccagcccccctcctaacttcgttaacacaacgacgtagcaattaagtagcatgggaactcgggctcagatggctgatacagttgtcctccgttaatggggtgagacaaagcttgcgtataatatacagtgctcttcaccaaaatgcagagctaaaagagattttaagagataatcagcaacatagcctgtaaatcatgctgctcataacagacggccaccttactgaaatctcactgacccccaccacacgtgttaacagcagggccactgctctgaaatattagctattaccgagtggccaagtcttaagaaagggaccacttggcagtattgaacttcaaagtggaagtaagatccccttggggtgagggtaggaaggcggtgaacagggttgatcagaaccgtggaagagtccggagcagatgctctgtgggaaaccctgaattagccaagagcaaaagttatcgccatcctactgctctgggaaggctgcctgttggagaaaacctctgtgttcccttagccttttcactgactggaggactttccagacgaaatctggcacttctcagtaaccttgaacttgaacattcagtgacagaagggaaagggagagggtttcagctgctggagctgggtaactgtgcagggctctcgcagcgggccatttgtggctctgagggtgccaagctgcagtgttctgagggtgtgtgaatgagggtgttgatcctggctgcagaaggggcagctttctgagcaggtgggagtggtgaatgaggaggggatttggcggggcaggatgtgagatgagtttactctgctgggaaagaatttggagatgtccatgaagaagaaaatctggatgactattgagggagggctgatgttggagagaagggctcatactacaaatcagaataaaataaaggatatcttagtatcaagaggaaagcactgttaagatactaaaccttctgctgcccaggtatctgaggagagaccatggaagagttctatatggaacaaatgaaaaagcagtaaagtcaggtctagacctggagtttttagtaataccaagtttacataggaagtgtctgggaagtagtgattagagggaaagtatgttggatgagtgaatcattccttcagaaatcaatattttttcctactaggccctccgaatgtcatctttgtagttgcccaaatacatcagtttctctcttatgtaagagagcttgtctcatttttattgctgtattccattttcaagtgtcttcttgggtaatgatcctgtatttgatcttggccagatattatctgtgactgttgttagagtgatccttttcctttcccccgagttagtcaaactgtgtgcgtggtctctagactgagatttggcagtgattccatggctcttgtgagtggagttgactaacaaaactcaggaatggaatggccatattttggaatttggttgaagcaagtaaagtttttattcttctaccaatgcaaatctatctcagggaatttctctttattcagaaagaatgacctccatcccacctttctctaaaaggtacaaatcgtaatgcatatttgacacattagttggcttttaccttggggaccagcagaccaccccgcagatacaatgcacggaatctagcaaacaataaagagcagtgtgctcgcgtggccagatcgttcgcttccttcctttttcgccttcatttttgggaagtccttgcctcgttagttccataggccatgagacatagcaatataaaatgccagaggatgttcaaatgggcgtgtggaggaagagggaaagcaggaattctgggccaaagagcagatggccagccagtgacctaggaagggaagctcaggcttttaaacaatggcaatgtttcttttatgtgcagttttcattaaggagtaccgagactccaagttggaggattctgaaagtggtcatagagtccctgccctcgagatttaatatccaaagaggagacagtggttttaatataatgaatatatgcagaaaacagccggagacaatagaaacactttggcaccttctgtggcgctgctaaaatgtgtgctgtagctcaaggcccataggggttaatgtaggggttatttgtgtgtgtgtgtgtgtgtgtgtgtgtgtgtgtgtgtgtgtgtgtgtttggtgttttccccatgaagccctgattgtgcgaccctgggtgagccagctgcttccgctgttttccaggaaagcatgagtgtccaccacctagagagatgatgatgtgagaaggggcagggagagacctctctggctgccactctctcactgccccaggagcggaggcccctggtgctcaggagttctttggctgtgtccggatccaccaattccccgcttccctaaggatgacgggtaaatctggtgagacccgctgccctcctaatgttggaggaaagctggagcccctcagtcaacatttatggaagggatttaatgcatcatgggctgtgaaggtacagccaggccctccgtcagctccctgagacaggccttgtctttttgcacgcatatgtctgttaatagttgtagacctagctgtagccatgggggtaagcctagtcctccagcccctgagagtttattaccacaaggagtgagaacaccaggatgtgtttttttagatgttcttctgtaacccccaagcacctgtagctcccaggtgtttttacattgatctcagaattacccagaaaacattctttgaagaccttgtagagtctgccatttgtacttctgctacaaagagcaaaaataaagcaaataaacaaaaagcccctggaaatcctatagttatcctaatacatattttaaagtattacctatcactgagcaagtgcatctatacatttcaatccttttggaaaatatactttctcaaacttcatgttgtatccctctaaagttagttagcacatattgtacattcagaagaaatgttcatttacagcaaggcataggttttttttcctctaaaagaaatttgaccaggtatggtggctcatgcttatattctcaacattttaggaggccaaggcaggaggatcacttgaagccaggagttctagactatcctgagcaacaaagtgagaccctgtctctataaaaaaataaaataaattagctggatgtggtaatgtgtgcctgtagtcccagttacccaggaggctggggcagtaggatcccctgagtctaggagtttgaggctgcagtgagctatgatcatgccactgtacttcacgctgggcaacagagtgagacctctgtctctaaacaaaaaggaaggaaggaaagagggaagaaaggaagggaagagagagagaaggaaaggaagggagagggagaaggagggaaaagaaaaagggagagaaattgatgcaggaagaagaaagaaagaaaataaaagaaagggaaagaaactgatgaaggaggaactgggtacctagaagtggttgaatgaaataatcctgtaaagtcatctaaggttcccatctcattccttgccttttatttcttgccatcacctatggccacttcttgcttgttcatgtcactttctttgtcagtttggaatgggccctgcctggctgatggctttggagaggacagcagacagtcattagagactagaagctgccaagcgaggcaacgtgacagagcacacagctttatgcctttttcttagtctactctcagcttggaaatgtaggagttatagtgacacagctcagtcagcctcttcctcccccgatcctggatcatccactctgcctctccctcccccagtcccagatcatcctgttttcctagaccattccttgccctgacaaatttctattactctcaggttaaagcccaactaaccctgaccaggctgcaaggccctgcgtgatctggccctgtcccttgctctttgtcttggactgcccttgcccacaccaactccttagcattctacagaggtgccatcctcttctctcctggcctttgcccatgccactccctgaaacactccttctatctctcttatcccagctgatggctctttcctaggtcttatctccctggggtcttttcttgaactcctcaaatctggatgagatgtccctcatatgtgccctcatgacatccgttttgaaacttctatcacatcaccttgtttgtatgcatcatttgtcaataagcccacgagatcagagcccatcttggttttgagcttatgaacatagtgttgggagtaggtttggtgctccataaatatctgttgattgaaggagtgcgtggaaaacagaatttggtctttgatttttttctgtgtttggctcagtgtctgatgctctcccgagcattcttatcagtccacaggattttgcaggactattagcagagggtaatgcatatctgcaatattgtcagacatcgcctgttgttagacgtttgcttatgcagggaaaacaatatggagtttttaatttttagttggaaattcagaatattaagttacacataacctgcagtggtttggtttttaaattgagtttctgcttgttgttaaacccaatccgaatcaactaaagggaggtctattctctctacaaggacactgtggctctctggatattcctgtaagacaggaaaaacgatcacagatcaattctagttgctgcctctgagaaagaagaacaagatagatgggtctggctttgtgaggaacctttctctctctcctccctcctcctgcctctctctctgccaataattacaaagctgaactgaactgctactgagaatccaagttctttcctggctctgactaagagaacatagatagcatatgcatctagattctttggctgtatacggacatatatacatgcacacacatacactctgtctttggcctgaaatgacggcactgcactaagacctgttgtttgtttcttaagcagatggatggctagatttttctttatatgaatctttcatgattacttttactaggacagagctaaaagaacatgggatgtgaagtccagtgagttggattgattggatgtatgcgtattgagcacctgttacatgctggacattatcagaattatccgggtgaagaagatgaggcctctgattgaagtggcttgctgtgtaatgtggttacactagtgccacttactctataactttggcggacaaattactggacctctttaaacttcccattgcttaaccgtaaaatgaggatagtagcacctactttatagtgtttccaagagcatctaccatgataatgtttgtaaaattcacttgacatacacctgctcatccttgacatctcccagtgcagtcaccggagcgcctcccagcgtcctctggcacaggtaggtgcttcccctcgtgcagttctctgcttggacacttcactccgtgctgtcagcaccctttgcttctgttcctgcacttgtgccaaaccctttggatgaagagcctcgttgtgcccatctctggattcctagtgccaagcatggggtccagcacttgacacatggctgttgctgaataaattaaagaacaaggattatggatggccaggtaccatgcatataacatccttattataagaactttgggccagaaaacagaacaaaaagggagagtgctttgaggccctggagatcagagcaaatctcggcaatatcacgctccaatttgaaggctgtaagtgtgtgctgctttttagcatggatgctgatcaactgcccgaggtaaaggaacctcttgaggtcaggaaggaggtctgtatgtttagtctggaggtcagtctacattttggttagctaacaaaactaacagacctaggtggttggcaattagaggcgcattttgattgttttatgccatatactctacaactcacatggcagcacttttttcctcctgatttcctttccctttgcaggaagaaatgtgtttctccttttcttggaatctccttattttctgctccgattatatcccttttttctgctgttcatacaatttcaagaattaatatgagttatgagggttctccagagaaacagaaccacaaggagataatgtatttatttattatgagaaattggctcacgtgattatggagactgagaagtcccatgatctgccatctgcaagttggagacccaggaaagccactggtgtcattcaatcagagtccaaaggcctgagaaccaggggaattgatggtataaatatatcccagtttggggattggagaagatgagatgagatgtcccaatgtaagctgtgaggcaggggaaaaaaagggagtgactggtgaattcttccttcctctgcgtcttgttcttgttctgttcaggcccataatggattagatagtgcccacccacattggggagggagactgctttactgttcaggagctaatctctccggaaacaccctcctagacacacccagaaataatgtgtaatctgggcaccccataatccgagtcaaattgacatataaaattaaccatcacagatattaatgtcattgaggttgaaaggagagtgttcttgtccttagtgtgtgtttgtgtaaatacaatttctaacacaatctgagtgtgcaggaaataaggaataagcactttaggggaaaagatcatgtctcaaaggatcatttttttttctttacccacccctttgactctcagcattgaaatcaaagtaaggccctgagcagctatatagtagaagaaagaaagaaaaaagtaagaccagatggttgtttggaaagaaacagccactcttagcagttatgcacagcataggtagagtaagttcttagtgctcgataaatgaatcaatggttgcactttttagaaagaccatttcttcttcggtaaagcttgctagttcttctcacagattctcttttcatccgttccataggttctgcacactggtgaagggtaggaacagagtgatcttttctttccttcttgctgggtttgccacaaagcatgttgaatggtcttgatgtttctccggtctataaataaatacttttttaaatggagccatcatgggatctgactctatttattcttgtcactctcttctctcctcccacagggaaatggcacatttaggaagagtttccattatttgtaacatttgatgatttgtgtctttcatagaccatgtatcagaggtggagaaacagcttcttaactttcagacttgcttgttcttgactccatgagccatctaggagagttaccccatttctgtaggcatccatcagtattcatcctctgtgttcacacgctttctcattatattactcttctcaagtttacaaatctcttctcattgatttcattttagtttggcatcatggtctagtgagactaacacttggctgggaattgggactaactgtgtccttggataagactcttaccattctgggcttgtagtttttctctgtaaaagttgagacatccagcttgatagttctctggctataagggcattttgacctccgaatactgaaaggatgcaggtaggggttgcaatctttcatgctctgtactttgcaagagtaatttggtcagctatctgaggcattcccatgagaaccaaatggaactactctggccccttcagatagaaactgttagaaataaaaagcttacacttgttggggggcaggcagtatattttacatctgctgataatatgctagaaccaaattgcaaagtgtacccatgtatgttatttagtattttcattgttcacatttttctcatttctaaactatgttgaatagtggaatattttgcttcctttggttttgtttgagaacctcttctccccttagtgatggtgctgtagctgtcgtcagcccaaaaggtccatactacatgttcagctaggacagggaccacatcagggcaggcatctcatataatttgactcagccctaatacactgattttcttacagccaaggattaactctctccattaaagactcatgtgaggggaagaacagatagcaaagtgtttgctaaaatgatgaactgtccctatttcaccttcaggcagcaaaatcatctgcttagaaactaattagagcattttccccaggcgttggtgatctacttctacatgcctatgatctcttagacagtagttgtaccatgttcaggaactggccataaagcagccctctccctagcctgtctccctctaatagaagaaggctgagagtggctcattccttcagatgaatctcagaccttttatttcagattcatttaagggcatttacttctctgtgatgctccttactttctgttctttaaaatcttctttgcttttggatcccagggtagacaaggaaaatgttgcaccatcatatataggtaggtaggagactttaaggtgctcaaagcctggtcgacattttctggtggcacagatgaagccattttctatggaagcctcctaggcaagactctgtcctgcatcccactgagtatagacctaatttctttctaatatggatggaggaataagcatggtcatttatcatgctgaggcagctgtaagccgtctgcatccgggttccattgcaattggaacagtagcaaatccattgggtttctttgtttttcagggtaattttctttcccttacagtgtactacagatttggggtctgtggtcttaagtgaacatttacataaagttagctatttatgattttaaacaaatttcatgcccctttctgctgtgttgttggtatttttggtttctatgtatcataaaccacagaagttcagtgacttccatggaatgatgtggaaaatcaggaagtaagactgaaattaagaatgaaaatttctgactatatgtgtcatgctcattttcaccgtttaaggtctttcagaccacaatttagtgaataaatctatatagcaaattttttaaattctcacgttttatttattattattattatcatttattattatactttaagttctgggatacatgtgcagaatgtgcaggtttgttacataggtatacacgtgccatggtagtttgctgcacccatcagcccgtcatctacattaggtatttctccttatgctatttctctcctagcccccacccactgacaggccccagtgtgtgatgttcccctccgtgtccatgtgttctcatgttcaactcccatttatgagtgagaacatgcagtgttaggctttctgttcctgtgttagtttgctgagaatgatggtttccagcttcaaccatgttcctgcaaaggacatgagctcatccttttttatggctgcatagtattccgtggtatatatgtgccatattttctttatccagtctatcattgatgaacatttgggttggttccaagtctttgctattgtgaacagtgtcacaataaacatacgtgtgcatgtgtctttatagtagaatgatttattaccctttgggtatatacctagtaatgggattgctgggtcaaatggtatttctggttctagatccttgaggaatcgccgcactgtccacaatggttgaactaatttacactcccaccaacagtgtaaaagcattcctatttctccacatcctctccagcatcttttgtttcctgactttttaatgatcgccattctaactggtgtgagatggtatctcattgtggttttgatttgcatttctgtaatgaccagtgatgatgagctttttttcgtatgtttgttgaccgcataaatgtcttcttttgagaagtgtctgttcatatcctttgcctacttttagatggggttgttttttccttgtaaatttgttttaagttccttctagattctggatattagccctttgtcagatggatagattgcaaaaattttctcctgctctgtaggttgtctgctcactctaatgatagtttcttttgctgagcagaagctctttagtttaattagatcccatttgtcaattttggcttttgttgccatgcttttggagttttagtcataaagtctttgcccatgcctatgacctgaatggtattgcctaggttttcttcaagggtttttatggttttataggtttttatggacctaaaaccataaaaagtctttaatccatcttgagttaatttttgtataaggtgtaaggaaggggtttcagttttctgcatatggctagccagttttcccaacacaacttattaaatagggaatcctttccccattgcttgtttttgtcaggtttgtcaaagatcagatggttctagtcgtgtggtgttatttctgaggcctctgttctgttcattgttctatatatcagttttggtaccagtaccatgcttatacagcatatttttgtttgcactttcattgtgaatgctaattgtttttacttaaagattcctccttgagtagattcaataattcaaactggacatgaacatgtgactttttgagatggaatcgctctctcgcccaggcttgaatgcagtggattgatctctgctcactacacccaggttcaagcaattctcttgcctcagcctcccaaatagtggggattacaggcgcgctccaccatgcctggctgatttttgtatttttagtagagacggggttttgccatgttggccaggctggtcttgatcccctgacctcaagtgatccgccagccttggcctttcaaagtgctgggattacaggcatgagctactgagccaggccatgtttgaatttttacaagactaatttaatttcacatttcataggtaacacatagacttagccacatttttcatattggtgcctccatggtagataagacattgaaactataatgcaactaagatcaaattttttaaatgtcagaataactttaataaataaatttgctcatccttttttgatggaccctaacaatgatcagtttttagccatgatgttatctgccactagactgtattattttctcatttaacatagcttcatggtactaggaatggaaggaggaaagggggcatgaacttctcaagactgctttgtaagtctatttctttctttgattcccatacctcaaggaactgagagcaaactttgagcctgagtgtaaagtttgttttcctggaaatgtcaccaggctgtaaactcagaaacagattgcccccaaaaaattccctaaagggctctttacttttttcttgtgttacctttttttcctgtggcattctgtctcataatatgaacctcatatagttgcctcccaaacttttctgtttagcttttttttttctctccaagaggaatttctttaagtacactatggaaatgtgcataaagatgaaagcctgacttttctaaacactgtgttataaaattaattgacaattaattcaacagatgtgtattgccacatggatagagggtaaaggtagtcatttgtcactgacttcgacaactgagaaaaaagtgattcaagggagttggccctgcatgtaaggaatttcaggaacaatgtggtcaattaattttacttaagatgaatgtaaacatcatgtgtacatgcagttctttcaataaatacaaaataattgtaaatgataaagtggcagataaatcttagtggcagataaaccagtgcctctaacaatccgcttctgccctgtggcattttttgaaatgttactaatttgacagactaaatgagcatccagtattatttagcttttaaaacatattatttgtgtttttttcctttaatattttgcttagaaagtctttctctactctaaggtcaaataaatgttcagttaaatagatggaatattacctgtttcatttttacattcaggccttaagattttattagagaaacttccacacatattcagaagtgatgagaacagtataatgaattatatgtactcatcactcggcttcaacagtgatcactacgtgactaatcttgttttatctgtatgcttacatccttctcacccttccccttccctattattttgaagtactagtcactcagaatttcagctataaatacttcaggttgtgtctttaacagacttaaaaaccaagcaagcaaaatgtcattattacacctaataaagctaacggtcatgttttcatattatctaattaatacctagagttcaaataaaatgcctagtatttttggggctgaagatacaacccataaaagtaaagccttggtgttataatacccaagagccaatattctaacgtgaggaaacagacaaaatgtaagtaaaatacgaacaagataatttctgctaacaatcagtgctcggaaagaaacacagtagatgacagagagagtgacgcagggccagggggatcctattccaggtcggtggtcagggaaggcctaggaggtggcatgagtgtgaggaccaggtgaagggcaggagctggcccaggggacagtgtcctaagtggagggatttgccactgcgtgaagagcttgatgggcctgcggagtgtcatctagctaggcacctttttccctgttaatgctggctttagttatagtcatttgtaatgtgtagattttcagtgtcttaacttttcaacagggtaaataggaccatccggagtacaccaatattgagctttgtgataccttttggtcgatttgttgatcagttatgcttcattgtccatgaacatttcagaaaaaaaaaaaaaaaggaaaaaaagaaatggaaaattcaggctacttaaatcacgcctttgaaacctagaaacccttaggggcacagacccttcttgtgtaataacagagctctattttctgctgggaagttccctattgagatttgggacacttcctaattttttctgggtaaaataaaagtgacaacttttttttctaatgactttttaatacttcttcttatctgagtaaaaaccaggaagtgggaagcaaatgtacaaaaaccagcaatacacacacacgtgtgtgtgtattttcatgtacatatgaatgtgtatgtgggtgataggaagaagagaggatgcatagagaagatgatctcgatcaagtttgatgtaaatgtaatagcaaattagagtacattcttgtcttaatcttttctgtaataaagataaaatggggcattatgttcatatgattgaacaaaagtggatgatttcaacctttttcttctcagccattaaaagaagaatttgaaagaaacagtctttgcatacatatacagagagtttgtcagcctttcttcagacacagccagccacagtcagactaaacattcgaagacgttacatttagtccacagtggaagtatttgttgattcacatattttctttttacaagaaaatcttcagggttagtattcacccctgaattggacacaaagtaaaattccattgtgttataagacagcttaaaatatctttgatttaatccagaaaattctatcactcttactcctgaaaaaggtgctggtattttaggctttaccagtcagctacattaaaagctgtggatagttttgcaatttatgaaataattactcttcctcatttgtcttcttgatttgcccgacatcaatgctcttgtgttcaccagggactaatgattgtatttttcttcccagtgggtgggataggataccagtaggtgggatagagagtttatggtagattcagtttgtctttatttactcaagcactcttccagggcctggagctgtcaaaggtgaagtaggaaattactgtttacatctgtcgggaattcactgttctgtctttcatgagctttcatgccctttagagaccattttgcacaccttgattgtcagaaaagggtctgggatgtttttggagtggtacagagatgcatacagcaacttacactgtcatgactttttttttgagatgcagtctcgctctgttgcctaggctggagtgcagtggcgtgatcttggctcactgcaacctctgcctcccaggttcaagtcattctcctgcctcagcctcccgaatatatgggactacaggcatgtgccgccacacctggctgatttttgtatttttagtagagatggggtttcaccatttggccaggctggtctcgaacccctgacctcaagtgattggcctcccacagtgctggtattaacaggcgtgagccaccgcacctggccctgctatgactttcaatgctctgttgtagttttttcttaaaatttaagtttgcttggcaatacctttttttttctttcttttctattttagacagagtgtaactctcacccaggctggaatgcagtggcaaaatctcagcttactgcaatctccgccttccaggttcaagtgattctcctgcctctgcctcctgagtatctgggactacaggcgcacaccactgcacccagctgatttttgtatttttagtagagacggggtttcaccatgttggtgaggctggtctcaaaactcctgacctcaaatgatctgctagccttggctttccaaagtggtgggatttaaaggcatgagccactgccccccaccccaccgccccaccttttttctgttcttttttttttttttttcagctcactgcaacctccggctccccgctccccacgccccccaccaggttcaaacgattctcctgcttcagcctcccaagtagctgggattataggcacatgtcaccatgcccggctaatttttgtatttttagtaaaaacgaggtttcaccatgttggccaggctggtctcaaaactcctgaattcagatgatccacccgcgtcggcctcccaaagtgccgacattacaggcgtgacccgcacccagcgccacaccccctttttttcttaataagaaaatgagtagacacatccctgggtgccaatcactcatgtatcaagattgctgagtatgagaaatcagtaaattaatatgaagaacttaaaacacagttctagccaaagtaatgcttaataagtacagtattgtgcaattattgctaaatagcatacatttattgtgttcctccatttaagatactttcaagcattgtagggaaagaaaagcacataagctgtagtctttagctttaacggacttgtagcctagttgagagaagccatatgtgtaagatgacgagtaatagcacaaagcagtgtgtgatcagtgccaaatgcaaatatgtactaaaggagtttaaagcacagagaaagtttgctgtgaactggaataatgataacaatggtagcaacagcagccagcatttactgagtgcttcccgtgtgctaagtactgatcaagtctcttacaggtattcgctcatttattctttatgtcagccatataagaaagatgtttctattagttttcctgctttacagctcagaaaactgagtgaggttagctaacaggcccagggtcccacaccagggaaatgtggagtctgggctgcctgttagagtcttggctgcctgactccagagccccagtcttagccacgtcagggtggtctaggagaactggatcgaagtagataccttacgggcaaaggaagccgaccacctcatggaagagtctggtgtatacaggaaaagagtgaaaggtacaatgttggggcatgattaaagggcctttagcccccgttaaaggcactttgacctgatccagaaagtagtgggagaaccagcgaatgaacttagcaagaggaatgttgggtgcattgcagggcagccactatggctcaagttggggctttctgatgctttctgcttcagtctcgtggctgtctagtggtttgattttccattagccctttctcccttggccttaagggatggatatctacaaaatcttagctatcaggcaaaacctcactgtcccactggtgataagctgggcttcccagcagttcatacgaggcctgcatcctgctgtgtaacctgcctcaagactgcagaaggcagagttaggtgtccttccccctcagggccctctttatgcttctctggatttggtgccaaagaatccacagtttagggcaaccgtagaaaccccaggaggagtgtggtagcgtgtggagaccctactaagataaccatagccttagctgctccttgaggtctggctctgggtcccaggggctgcttagaaggatccttagtgatcccctggtcaggacatcatatgtttagagagcaaggttagaggagttaccacagttttcttctacatgctgattaatctaggatttaaatacaggctccaaaataaagtgtaagtggtggtagctcaaagaagcaaagcaagcttcacattaaatgacatgggcttctgaaaatgtgggaaggactaggaacacaggctacttactgcatctataactctctttagacaaagaaaatatgtgattaggaaatgttttggcaagatctcaccaagattatttactgcaaaggaggcccaggactcagcctggcagggaaaatggggcgggggggcgggagtgtttactgggagtatggaagagcattttaaagtatggaagtagattgaacccctgtgctggggctggggacagggagtaccataatacaattttatgctgttaggggatctctgcaaaacctagagtaagtagaggaaggagtctgtttgaaattaggaatagtagggtcagggtccagatggaggtggggaggagtggggctcagacctgaccactgcttctctaggcgtcgtttgaatatttaaagacaaagcacagtacatttgctattttattttattttatttcattttatttcatttcattttaaaccatggctaactcttctccagtcttctccaggagaaaaaacttgattgtcatcctggcacaaaaatgtccacagttaggctaacaggcaagcttccgtgagcagatcaaatttgctattctggttccaacatttaactccctagctttttttaaaagaaaaaataagctggcatcaactgaaatttcaggttaggggcttggtttgaggatgtttggggaagcgggagctttctgccatgtcttttgtggacattggatgtatttccgcattctggttggccacatttccccctggggcagattcttcagaatcatttgtctcccactgggagtctttttccctcccccccccccccacccccctttgtctttttctctgacatctgccgcacactctctccagggcatacggtccagaccctcctgggagagcttcatctgcttagtataacttctagcagaagatagaactgatggattttcgtgcgcaaatacagattcacaagggtgttcggtgtcacaagcatggatttatgatgcagtttgaaaagggtcagaatattcagagatgagattaatgccagcccatgagtgctttgtggtgctgaggtaactgaagtgcatctggtggtgtccagagctcaagtccccactgcagacgccaggaagaaagaggtggctcgcagactgagaaggggcgtagggatgcacccttcttgtctccttctgcttgataatttagatagaggatggcaggtgtaaatcagtttgtggtagatgcagtgtgagctgtcctttctcccccttcctcacgtccttacaagacacctgtctgctttgtatcgattccggcactgtgttatgatattcttgtagtttcatttttttgttgtttctcttttgatattggactttatatgcaaagaatgggattagtcataatctttacttcaaaacacattatcttcatatttttatgctggttgtgatggcacacacctgtagtctgagctactctggagactgaggtgggagaatcacttgagctcaggagttcgagtctgcagtgagctatgattgtaccaccgcaccctagccaggacaacggagcaagactctgtctctaaaaaagatagaatgggctgggcacggtggctcatgcgtgtaatcctagctctttgggaggctgaggcaggcagaccacttgaggtgcagttcaagaccagcctggccaacatggtgaaaccccatctctactaaaaatatgaaaattagccgggtgtggtggcgggcgccggtagtcccagctactcgggaggctgagccaggagaatcgcttgaacctgggaggcagaagttgcaggaagccaagattgtgccactgcactccagcctgggcgacagagtgagactctgtctctaaataaataaataaataaataaaattatataaaataaatagtgtaataaccaactatgtagtcacttcaggctgctataacaaaacacataaactgagtggcttataaacaacagaatttgattctttccgtctggaggctggtagtctgaggtcagggtgcccaaatggtcaaattctggtaagggccctctcctgggtttcaggctgctgacttctcactgtgtcctcacatggcagaagggcggggagctctctaaggcctcttttatacgaacctaaatcccatccatgagggctctaccctcatgacttaaaacaccttctagaggccccatctctaaataccatcacattgagagttaggatttcaacatacgaattctggggtaacacaaaccttgtctgtagcagtgaccataaacccatccccccagacaaatctaggacctggagcataacctgcgtctgagcagattgccatccttcccacacctcctctcccttcttttctctacccaaggtaactattatctgaaccctgtatacatctatgtttccttttctgcatactttatttcgcttacatatcgttctaaaatggaacacataaaaacataagacatacacacataaaaagtatgtagctatatagatatgtatttaattgttatcacctttcaactttataaaaaggatatcagaccatatataatcttttgggacttacttttttacttaacgtctcgactgccagcattcatgtgtattgctatgcatcacggtagttaatttgccttgtctgctgtatgatgttccatcatgagccgattatacacagtttattcattcactctctcattgatgggcgttgaagttggtgctaggatcttggcaattgcaaacaggtttgccataaatatattcatgtatgtataatcagttgtccacgtgcaaaagagagtcctttgtgttcgtgactccattattttgaaaccagcagtagtactgcacactgggagaatgtttgtgggaagcacaataaaggtaagtcctcagtactttgtatttcagtttggtgtgaagaagtagcatgtagacttcataggagacaagacacttctatggtttgagtatttgtctcctccaaaattcatgttgaaacttaatgccttaatccccggtatggcagtattgacacatggggcctttaagaggtggttgggtcatgagggttctgccctcatgaatagattaccccattcatgggttaatggattaatggattaatgggttattatgggaatgggactggtggctttataagaagaggaagagagacctgagctagcatgctctgccccttaccttgtgttaccctgcactgtcctggaactctgctgagtccctcctagcgtgaaagccctctccagatggggccccttgaccttggactccctagcctccataactgtaagaaataaatttcatttctttgtaaattacctagttttagggatttggttataagcaacagaagacggactacatatcttattttaattttgttcctcccactaacttcccagccccacagtgcttggagcaactgtttctgcagtcatgacttcagtacagttaatgcctgttgacttcatcttatgttaaattctttgcaggtaaagccatgttccttataagatcagtctttttttgttcctctatgtgtctaatcaggtcaattctttgcattattttatttagcatcatctaccaggaactaggcaggcattgtcttaataaagcctggttcttgcagttggagaacttgctatctagctgggagaggcagtatgcaaactaagatttagaatgcgttatgaggccaggcgtggtggttcacgcctgtaatcgcagcactgggaggctgaggcggatggattgcctgagcccaggagttcaagaccagcctgggcaacatgacgaagccatctctacaaaaaattagccaggcatggtggcacatgcctgtggtcctagctacccgggaggctaaggtgggagaatcacctgagcccaggaggttgaggctgcagtgagctgtgattgcaccactgcactctagcctgggcgacaggatgagaccctgtttcaagaatagtaataataataaatttaaaaataaaatagaatgcattattatatgtaccttagaacttaggtcttagagagtgcctacctctccttgggagagaagacttacggtggtgggagacagtgttgcatctgtcagataaattagggaaggcacatggggcggacgatttcagagaagttaaaggcatgggagaacatttgccacgcaggccgtggcaagtggttggctttgactgtaacatgcagcgtatgcagttcctggaggcagatgagggaagtcatgcagtacttgtgtttctgtgagtctcttcagttttggggtttgtagacaggtcatgttcacttactcctaacctgtctcccacaatagtcatctgggtctgtgctacttagtgtcatcctctcactctttcccttggtggcatatccagttggctaagaggacaggcctgaccttgtgcccagagtagggagaagatcccgatcacctctggtccttgtcaggctgtttgcttggatggtagagttcacccaagttcggactcaggaacggcctgtggtcatggagtagtttttttctgtccagggtctggaccaagataactccatcacaggggtagcaacagtatgtgctggggcaattctgctacccacttctggtgtccttcagtgctttccctgcactatctctgtccccagctgcttccatccatttgctttctagtgatgaagcactgggggaagctgcagggatggctgctgcacccacatccatccctgcccatctgttctcagagactctatggctagcagagggagtgatgatttcagggaagagtaccagagagggccagtgggtagcaggagtctcacttcttggagaaaacagctggtcctctgtgaccaattctccctcaaactagggagattatatggccactgcatacacaaacacacatgcttgcgaagataggatggagttgtaccaaataaaaagtttattgaaagggatggtggtagagaaacactgtatcatgccgtggcataacagggtattatatgttggatggctttttggaaatcattttaggccaaccttattagagatctaatttatttgtattcttgtagctacctagcacagtggtaagaacacagaccaacatttggtaaaccttggtttgaactctacccctgctgcttctgacctctgtgagtctgcatattatttaacccctgaggctcagtgtcctcggttgaaaaatgggccactaatttagtataagggctatgtaagatgtaatgcacatgacatgttttataatagcttcttatggaattatctgaattggggacccatctgttgcttttataaaaagttcaccccttaagacaagtcagtccaatggccatgtttaaaccaaatgtactgtcttctgtaatgctcaatatatttttcatgtcattgagtgcagagactaggtgggaagatgatcatatacagacagaatgggcaccactctgcctaaacatggctctcgctttcaaaacagtactttaaaatatctcctccctattaaacttttccagtgaagactctttttccacctggttattgtctctgtgtttgttacagccttctctctgctttcagatattcaactctgcaaagtcgtaatcatttatccacatgtacttttgtgtgtgtttgtcccatctctctctttagaagacatgttcctgctggtgcttggaataagacgttcttttccctccccgtggagatgctatttttcctctctttaaggagctaggagagaatttggttcaacatgtcttatgtatcagtttagcactgtgcttttcttcccttagattgacgtgtgatttaaaaaaacaaaatttggaaccggtcatgtaaagatggtgtatgtcacttagtataggtcatctctgtaccctttgtatactgaattttgctgtgacctgtcaaaggataccgaagacaggcccatgcgaaacatttaatttctggcattttcgtgcatgtgagactcatctgatgtgaactgaaggtatgttatccttccttttaatgataccaaatctggcccaaattcatatgaccccttagaaaattactgtgataggaacagattctaatgaattgaaatagagatttctccacctcacgtaattaggatttgagagttaaataagaaagtcagggatagggacagggatagaatggcatggagaaagttggagccaagaacactgaggaaaagaagggagtgacagcagcaaggaccattgctgttaggaagggaattctttcatcagacactggaattctcctgccaggcactggagtttgccctagcttctgtctgcttttactggatcctgggtcctccagctgaagtgagttgtattacaatcccttccagttttgcacttcagggaagtgaaatggagcaaatcctaatggcacaggctggagggagaaggactagtttctttaatgtgactcaacacctggcaaggctgtctttttctcaaccgggtttcatctgttagttctgcaacatgcagagtcagattttgaggagtttccagctctcgccttcatggctgtccttgtgtttgtgtttgtgttctccaggcgcctccttctccactctttctccagtgctggagacctaggggtgtgcatcctggaggattgtgaggaacctcagctgctcccctcgtcctctgaccaggcggtgggctcagggagctttggagtctcatgcggtcagcagcgcttagcatgttcagttggctttttccatatcaccagtgacatctttcttcttcctaatcatcgactcatggaatattagaattaccaagcctcttgcagttcctgtggtctaattccttcattttagagatgaggacccctaaggcctggggaggggagatgataggtgtagggaaaaaaaaaagaaactttttcctctaaataagattagcaaaacgataaattaacaggagaaaaatagagagtttattaacacgtgcagcacacatcacacaggagaaacctcagtgatgagtaactcaaagtttcaagagtttttatttcttttttctgtatagcacttgtcagtctctgatattgatttttacttgtttcttaatgtttgttctccttccactagtacgtacactccatgggaacagtgattttcatctgtttgtcactgctttattcccagcacatagagctgtgcctagagtggtaggcagatcattgttaaaacaatgaatacatgaacttcgggcaagttacttaaccattctgtacttcagttttcttgtgagtaaaatagggattaaaatagtgcctacttcatggagttgcaataaaaactaagggagttaatccatctaaagtaccaataacccacctggcccatagtaaatgctcaataaataggttcccagccaggcgcagtggctcacacctgtaatcccagcatttgagaagccgaggcaagaggatcacttgagtcaggagttcgataccagcctgggcaagtggtgaaaccccatctcaactaaagatacaaaaattagctgggtatggtagcaggggcctgtaaacccagctattcaggaggctgaggcagaagaattgcctgaacccgggagatggaggttgcagtgagctgagatcatgccactgcactttagcctgggcaacagagtataagactctgtctcaaaaaaataataataaaaataaataagttccttattataattactaaatattgtatttcctcactagaatgcaaactccttgagggcagagactatttcttacatcatctttttatttctagtagcaatttggctgacacatgattgatattcagtgtttgttgaacagatagataagttatagaaaaattgtaggtaatacttctgtaaataattgttaaatttaaatgaatagatttccttcctgtctttttccctaagctgcaatcagtgaatctacatggattacatagattgtgactacactgtgccttaactcatcacttaggcagtggagtcgatcatttattttgttgccatgacttggctgaaatttcttggggactgacagcaatggcagaaacttgatgggtcctgaatgtcaccatagcctgtaagctacacaggagccacccgagaactcctccattcgtggttgtaacttcacagaaatgcttcccagtcagaggaggtacttagcagaggctgcaggcatctgaacagacaggtgcaggaaaagttgaaagggaaggttaagggagaaacatactcctcatctccgttctcaagaaacggcttaaaggttgtaaaaggattctgcttttaagcttgagtcactcatttgacttctgtgggccttgcaatttctctggtaaaattagagaatatgaccaagattatctccaaggacctgtcttactttttaagtttcctaattctgtgaaaaatgcttaagaaggcctcagactgattaagaatttaggggtgtaagtttaagtggggatactgataaaagggcaggggatgttactgtaagagcaatggaaaagtgtctgagtagtgtagcatatccatttgtgagaggagtaattaattaaaaaatgaaggcagaatccacatcttcacaaaagtttcctatctcctggtttggatgagtgtatttaatgtgaactaagttgcatgtgggctgtctaatctgggcatctgacttgtgaatccttcccataactaagccccgagagatttccaatcatgcccataaggtaatgcaatttggcaagaggatttggacttgacgaaatctcttgttctatttggcatccagaaaaggctgacttgcctaatttgaaaataaattgaaaacaaaaaaaatttaaaaaaacctctggttgttccttgtttgatgaaataccatagaaaactattactctttttccataccccattactatggagaatatgtttttaccactgactcttctaagtatctgtccttagtttcctgtccttccctgccacaggttccaggaaggctgaatcactacagcatggtattaaatcatagaaatacgtgtgtattttgtaccatgtgggtctgcttgcattcctaacatctgcattagtattagttttctattgctgcataacaaactgccacaaatttagtggtttaaaacaacattcatttcttatctcagtttctttgggtcaagaatctggacacagtttacctgggtcatctgcaaagggtctcagaaggctgtaattaatgtgttagccagggctgtgttctgatctgaggcttgactgaggaagaacccactttgttagcagaatttagtaccttgtggttgtaggacagaggattttagtttcttactagctgttggttggaggcttccctctgttccatactatgtgggcctcccaacctagacacccacaacatggcagcctgctccttcaacaactagcaagggagtttaatgttttcctgtagctcatatttctttataggtgtgacctcaatttttcccctaatacctttgtaagatagaagtagggagaaccaagatagatccaaaaaggctgaatgaaatgcctgagattgagctggtggttgcattgaacaatataaattgatgaataacaatttattaattgtgccaggcactgtgctaagagcttcatgtcagtacattcttgtttagttcttagcacaaccctctgagttaggtattactactactaaactatttaacaggtagggaagttggggattagagaggttatgtaacctgcctaaagttcacagacagaaagtgcacagcccagatttgaacacaggcagattccagaacccactatcatcgcactctgaagatctctccattagagcacgatgctgccatgttcaggattcttcctatcttttgttaaatacttaagttcctgcaatattgcaaagggataattgtaataggttgcccctttcaaagtgctttaataaaatgaaaggacaacattctttcttttctgcttgagccaggctttctcatttttctgaagacatctaggataaatggaaggaaaccagaatttagtggggtttgcatgtattgataacagttttgctgaatacacatccaagagctaaaacatgcaaactcttcaaaattggtagaatacagcttgctcattttaattcatttaaaaatgttcattttaattaagcattacccattttattattccataaaacacgaatcatctggaaaaggcagcataggtctatttttccagcctataaaactatatgtagatggatcttgatgagggatgtacaagatttaattagaaactgaaattttagagtaaaaaaatgcaggggtgtgtgtgtttcttctatatttgtggaaacccaaagagctatcctgcaggatacttgaaaatatatataaatacagaggagaaataaagtgcggagaaggtttgttgattattgagctttttcatgggtgatagaatggagcagctgtaggatggaggtaaagaggataggaaaatgctcttctgggtcagacccagccccacatcccaaaatgttgtggccaccctctgtgttatgtaaaatgtaggaaggtcctcccagctggaggaccttcgagtatactgcgttccccctcctcattcactagggaggatgcaaaggtgcaaatgggccaaggtcatgcattggacttccttcattaaactgttatgaatttgccttccctgagctcctgttggaaaaatgtcttgaacttactgttgttgtttctcctactgcgtttgtatttctttttataaaccttagtccaagtcagcccagtgctgtagttatttgtgtatctgtgtcattctccctaggatgccctgggccatttttaatcaactttgatcccctttcagtgccttgcatgaggcctggaacattggaggtacacactgtgtattgactgaatcgagtgaaaggtatttgaatatacagttgactcttgagctacatgggggttaggttgctgacccctcacgcaggaaaaatatctgtgtataactttttaaaaaataaatttgggggtacaagtgcagttttgttacatggatatattgtgtagtggtgaagtctgggcttttaatatagccttcaccctagtagtgaacattgtacccaataggtaggttttcaaccttaacctgcctcctatctttggagtctccaatatatgttatttccctctgtatgttcctgtatacccattctttagctcctgcttataagtgagaacatgcaatatcttactttctgtttctgagttatgtatataacttctgagtccccaaaaacataactactaatagcctactgctgactagaagctttaccgataacgtaaatggttaattaacacatattttgtttgttatatgtattatatactatattcttatagtacagtaagctaaagaaaagaaaatgctattaagaaaatcataggagaaaatatatttaccgttcattaagtggaagtggagcatcataaaggtcttcatcttcatcatcttcatgttgagtaggctgaagagggcttggtcttgctgtctcagggtggcagaggtggaagatgcggaggaggcgggaggaaaggcaggccactcagtgtaaatttactgaaaaaaattcacatataagtggacacacgcagctcaaacatgctgttcgagggtccactgtatttcatctgtttgtttcctactgtggaagacagggcttccaggctttagttctaaaacttccattgtaaggccttgaggaggatcctctcattccagtaatctgagagttggtaaacaaattcaaagccactgtatcactgtcctttatgtccctatgttttttttttttacttttttttgccatttcttttttcttttgcactttaaaaatcgtggtaatatatacataatataaaatttgcccttttaaccattttaagtatacaattcagtagcattaggtacattcacattgttgtgcaaccatcagcgctctccagaacttttacatcgtccccagctgaaactctgtccccagcaaacgctggcatgcccttctcccctcccccagcccctggtaatcaggggtcttcttcctgtttgtgaattatgactactccaggtctctccgtaagtggaatctcatttgaccttttgtgactggcttatttcacttagcatgatgttaaaaggtttatccatgttgtagcatgtgtcagaatttcattcctttttggcagccattgtcttaagactcaagagtttaagtgtttttagtctctgtagccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaagtggagagagtgtggggaatgacattagggcgtatatgaatgccatgctaaggattggggtacaggtaacttggaggcctcatgcagttagactgaccccgttcgatctgtgggttgacaggggggtgtgaatggattggaatgggagagaccactgtgtggggcaaatgggaagggagcgtggttgcagcattttaggccagagatggtgagggcctgaagcaaggcagtgagagagaagaatttgctcatggtcaggtgcatcgggcctgttgacagcagagtttgttggactgctcccacctattgctttttgtcttctgaagtttttataatttcaattccagtttagaggtctgtttttagaacatttctccgatcttattatacccatagtggcaagaatgaattgatttgtacaagatagctggacaggttcctaccttcaggctttctacccaactgggcacttggaaggatagtttttcatagtcttcatgggctaagtgattgcatgtaatatacaatagctggagtctaactgtaattaaaacaggttagccaagctacaggagaagtatcccccccatccccacccccatggcccttccccactgcctgtaatctcttggtaacaaaagaagtcaaacaaaaatttcatgcaagggtataaacatactttgagtcatcagaacctacctagtggtccatagaaccttggctcttcatgaagggcttaccaggaagacatagtcgttgttcatatgcagtttctattctgaactgtaaaatgtgagcgattactttggaaaattagaagaaaaaatgaatttactcaggatccttaaaaggttacatttgtcatgcctgtaatcccaacaattttggaggctgagccgggtagatcgcttgagcccaggagtttaagaccagcctgggcaacatggcaaaaccctgttgatacaaaaaatacaaaaattagctgggcgtggtggcacatgcctgtagtcccggctacctgaaaggctgaggtgggaggatgacctgagtccggagaggttgaggctgcagtgagtcaagatcgtgccactgcaccccagcctgggtgacagagtgagacctcctctggaagaaaacaaacaagtgacatttataggagggtcccaaacatacaaatatggaaagtgaaaatactacttgctacaggtactgaaagaaaatactcaggagtcattattcaactgaaagcagattgaggcaaaggtgctgaaatatactaaaaataatgagtttcaaagaaaatcatcttttgttaacctttgcattagtcagtccttattttttcgttttagtcactcctttacaacaatgtgtataaatatagaagatgaagagaagtgtgataaaaataatttaagatttggaacatgggttttcaaaggaaaggttagagaaatttggggattaaaatggacagactttatcatcttcaatattaaaaaaaaaaacagaaggatatttacgagcaagccaatgaaatgataccaagaagtttataacacatactctgcccttatggggctttcacctagcggccatgtttccattgtgcagttaactactcagttattttttatttcccaagagcactaagtgaaagcaaatgcatgttaagtcgtgggggctattctgaatgatcaatagagcccaccagagtcccttataactaactacccattagcagatgtggagtttccttcttggggatggaggggactgagtcggggagcttcctggatgggagtttgaaccaaataatcttaattatgtaattcctttcaattttaagatttgagggcaactttagaaagagataagtaattgactgaccaactttataaagagatcagtaattgaccacccttggagtgtaagagtcaacacctaaaataaatgtatatttctaatattttgaaaatagaagaaaaaggaagaaaggaggaaagacaagttatctagtggagacgatgaattttcaggtcatccttctagtttttattttagacttgtgtctttagttgaaattattacaacttgcatgtattttgtctgtttactcattatttcgtctgtctcaccgttccaaggtaagcaccgtgaaaacggactgtgtctttttagttctttactgtgtttctgccatcaagcccagtgttgacacatggtaggtactcaagacatgctggctgaatgaatcagtgagtagtgaaggtggatcatggggagaagagtgctgcaaataccagagagaaggagaagaaggaagtggaggggatagcggaagaaggggaagaggagtgagtttacaaggcctttttttctttttttgacagagtctcactctgttgcccaggctggaatacagtggcgtgatctcagctcactgcaacctctgcctcccaggtttaagcgattctcctgtcccagcctcccgagcagctgggattacaggtgcacgccaccacaaccggctaatttttgtatttttagtagagatgggatttcaccatgttggccaggctagtctcaaactcctaacctcaagtgttccgcccaccttggcctctcccttgctgggattacaggtgtgagccaccatgcccagcctccaagccctttcttttaaaaaataaattttattgtttatatttgagatttacaacatgatattatgggatacatatagctaatagaatgggttgctatagtgaggtaggcaaccattctcacaggggtttgtgtgtgtgtgtgtgtgtgtgggacaagaacaactaaaatctacatatttaacaaaaattcctaatagaatatagttttattaagccttaaaaaaggagatcttgccatttgccacaacatggatagacctagaggacattatgataagtgacataagccagatacagaaagaaacatattgtatgatctcacttttatctgaaatatttattttaaaagctcaaatacagagacagagaatgaaacagtggttaatgccggtggaaatggggagatgtgggtcaaaggacacaaaatggcaagtgcacaggatgagcgtgtctagagacttaatgtacaacgcaaagactaaagttaacaaggccttttggttctgttgctgttgttgcattacgtaatagtgtgctaagaacaggagacacataacgtcatctaaaaaacaggagatgaagtgggccggtgctcaaacatgctagctccgggaaacaattcaggatgatttgccactgagtcaggtttgttaattttttctacaatagccaaaggctctcaaaaaatcaaggtttcctggtttataaataatctctggaggggtgtgtgtgtttcaggcatctgactcctttatttatattctctgccctggccttcagatgattttcgagcggctttcgattagattatctgcattgggataatggagcaattttgcagcaaactgctttggactgttcgactcttctcggcctgagtagccaaaaaataataataacttgatttagtctggtctagcctgctgtagtctgacttaaggatataatatcccagaccttagacacttgacttaatacattaacatattaacaaaagggtaaaacaaaatactagaagaaaacataataaaaacagcacattatttttcgggcatttgacttgaaccacagggtgccctcataatgaaaagaatattccaagggaaagatgagaaggcaattgagacaaccctaagcccctgtctgcccactcaaaccctctggccaccactgtactctctccaccatgagaaagcaggccaggagtcagttcagctgcctgtgtttaagtgcttttaatatccatggaggcacagagaaatgaaagcaggagccttgaatctagatttttccagaatccttttgagagacttattgtagcggcaggagctccattttgggggggtcaccccctgaactttgatggttttcaaatctttggagggccttggtcttagtggctcagaggtcccctgccaggacttctttaggatggggatgataggaagcgaacgttccttctgttgaggtgcatcagccttgcatctgagttcttgatgtcctcaggcctggcttcccagttggttaaaggaatgaaaataacaacgcctttcatttgcagtgcagctttaaaaatatttgcttttgctatctcattttatcctgataataaccgtgtgagaaaagcaggatggcagtcttactgtccttgtacacatggagaaatagatgcacagaggttaagttgcccagtttagtaaagggcagagcagggactagactccatttctcttcgctggaagagcccagcactatcacattgcaagattgtttcttgtaaaacagtcctgcataaaaataaaaaagagtagagagcatgatgtgaatttcagcttttagaggctgctgtctgtttttcataggttaaatagtgaatcagtgtgctccgagcttccatgaggggcagccctccttacctggcaggttactgagttttctaatgacttcagttttaggtgctaggagatagtagggccacctgcactgttttgtgagcaggacagataagaggcaagtggagagggtgggagagcactggcttgcatcatacaccccagctgcccttgcagggcccgactgttacaagccaggtatttctaggacgattgcattcctagccatatctgttttctttcagatggggcgtacaatttaccttttgagttctgtaaatggaatcgaggtgaaatctttactctggtgcacatatgacctgcaggttgatgctgcttgtttggaaagccctctacttcacagcgaacagtttgtactgtcaggtagacctctctgccaggggaccaactcctgtgtatttgaaaaggaagacaaacctgtattttgtagaaagggtctattgttcccagggggtggttgtggccaacttcttggactcctttggctgactctgaagaaggaattgaagtcagaatgctaatcactgacttgcacaggcctcaacaatcaaacctcagggaactcagaagaaagtaaacaagagcgctcaattgcagagtcttgaagaagagcagctgtgtaaaggaggctagacgtgaaaaaaacgtgttggagaggaaaaaaaatcacattccctgcttctcaaatgggaagtcttaaaaataataaagaatcctgagcagcgggctcatttcccatgagcaggcttgctgtggcaggcaggctcacctgctagaggtggtctcctggcttagaatgggagcacacctgtgggaatcgcagcgcttctctacctgagctggatgtagattgtttgaaaatcctagttgtgcactgcgtttccatcgatccctttcatgctcccacttgttcctttagttccaaatagcaggctggtgttgagaattctgtcatcatggggcgtttttttctaaatgtgagaaatgtcggaagcatgggtgttctcagattgctttagccactgatgattttccttttagtgtatggaaagaatgattttcttctcaatttctcccctctaacctcctgcatgtagatttatggattctaatcgggacctttctttgattcagtgccaggtacacaggccccgagtcgtatgtggcaagtggccaaggggatcggtcctggagaacgtcatggcacacaggcattggccatggagtggtgatccctggctctggttcttctccgtccagtgacctggcatgtcacctcacagggccatatttacctgttaactgagaaactgaactagaacatggttatgataattttaatctcaactttgtctcctcctatcttatggcagtaaagtgaccttttagcaggatcaatttataagccgtttgaagtctatcttttcttcccttagcagttgtatttgtgattttctcagcctgattttaagttattctgttataattttgaatgttctgttatgcttccctctgtggtgagcatacgtcgaaagctgtacatttccttcagggtaacctttgtttccaacaggagagagttctcactaccacatccagccttgatctctttaacctaaattggaataagccagacagagctggggttcatgggacagatgggagcatctcaagtttagggttggggagtctcagtgaaaaaaaaaaaaaaaagaacaagaatgtagacttggaatttgagaacagataaagcagtcctcacttgtgctctgcaagggagtgctgttgtcttctaaggtattgaacagactgggtgggaagctgctgaaagactggaaatttggggacttagcaagaagtataatggtgctgtaactgcgttttcttaaggaaacttggagctgaggtgccacctccctgggagggacttttccactggtttcttgcagtctggacatcacagacggcccagactcccccctgtcttgtgtacattcccttctacaagccttgctgtgttatcacaggtaccacttgtaggccagtatcatgggggatggacattgtttcattctaggcacattcaggaatcgtatatgtaccctgcctcgcttctgacctctcaagtcaacttttggagctgttagtgacttccagaaagctgacacccagtgccactcaaccaaccctgcttttctgctggtttatttttgttattcctaccccgactcatcttgcttttcagccatcaatgagaatttattgagttactcagacactcactcagaccctgtgggagagtagaaagatgtgtaagaaactgtcccagaattttgagggacttaaaatccattcgaaaaggcaaggtctaagcacatgaaaagttacctagcaatatcagctcatgaatggagagacagttgatcagagaaagagaaatgtctgttcaggagtggtcaggggaggctgcattgaggtgatgcacacgtgtggcctgaaagcttgattcgttccccaccccccattgtattctatatgtaatatttgatatataaccaagaagctatgtgagttacaaagcatgatgatacagtgaacacctatgaactcaccacccaacataagaaccaaaatgactgatattgataccctacctatatacctctaccttcttcctcattctacccctgccctcttatcccagttagccactgtcttaaattttacagattttattccgttcctttttttcttttttgaaagcgtttgatcttttcttctctcctcctctcctctcctctcctctcttcttcttttctttcttttcgagatgaggtctcgctatgttgtgcaggctggtctggaactcctgagctcaaatgatcctcccaccttaacctcccaatagctgagaatataggcctgtaccactgcacctggctagatctcatgttttctttggaaatctagtaattgtgatataggatctctgaatgcagaacacctagggcacaagtgatgcttaattttatgtgtcaacttagatgggccacagtgctcatatgtatgatcagatattcttctggatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctgctggcacatcttgcagattttgggcttgtctgcctctataagcacataagccagttccttaaaataaatatctgtgtgtgtgtatgcatttatatatacacacaccaccctattggttcactttctctggagaaccctgactaatacagcatatcacacctctctgtatgccacgtaggtagcactgcagaattaatttgcagagtattctcacatcgggaggtcagcagtatattaggcgcatatcagaaaggcatttggatgattctggcctacaccatggaagagaaaccttgattttctgtaaaagcaaggccagctttttttggagaactcttttctcccttttagtattctgtcccctcccaaagctccgtggctttctctggtcattcagagaccgttattccctccccagcatacatgcacactcatgtctatggtttcccgtaccttctctgtggagccctggttctgcctgttacaaggaaaggcatttagtttctctgacctcctgtctcctcagatgtcagtctgtatttattatgtgtcaccatgtactagatactgatttaagtgctttgcctgtttattccatggtattttcacaacaatcccaggtggtaactactatcatcttgttcattttgcagtgagaaaatggcaagaaagtcatagaaatgggatttgagtcctggtagtccgactttagagcgcttgcttctgacgcttctgaaacacattatgaactggaaattgctctacaaatatacactactgttagtatcacaatgctagtattatagtgcgcctattgccttggggccctgcgctctgctagttgatagctagggcatttttggagctgatgcaggctaatgagggtcgttgataggaaagtattgcttttcctagaaagctctggttctttgacagaagccttctggtggccacagttcctgagccctaagaagaaatcctgtagggtacctctaggacatgatggttagtgtagggtcatgagtctgctctctggtcatgtcaagaaagctgccccctactttgtgtttaagcagatcctggaggctgcaggatagcccattgagactaagtggagaccaggcatcaggtgaggaagccttagcttggagggtcagaggcctcagctagacttggtaaatatttggcacttcctctccctcacaggaccacagcaaatgttaaataatcacagcactctttagtttgaccaccactaatcgattgagttgggcaaatagcatggaaggtctttgcctattctttgggagctctgggtgtccccagagaattgagtctggcattaagttttgcctctcctttctcgttttcttttcccagccatatttctccaggttttcagcacaaactcaacccgttatttttgtttcttcagtgtctttaactctttccctgcctgttgagatggagtctcactcagttgtttagtaatggcagtacatcgagaagaccatcacacagcaagagttctaggagtttctttgcctgtgaggttagttttctatatttcatttgtggagggaacagaagtgatcccatttaagtgtggaaactttctttttggaacattttccttcctttttcttcatacatcgtggttccttctctcctgcactctcacatagataccagtatatagagatactgtttctaatcctgaaattccttttttgaagaaaagagaacattgtgtgccattgttttctgcgggagatctatgctgcgcttctgttttccaaacatttatccttaaagcattttcagatgtcagttaaacaagggagcaatggcccctgggtcctgttagggacatactcttaatgactgtaaaatgaataaggtatagaggaatattcgtctgaagtcatgatttgtacgtcatttccttgctttcttcaacatcattatttctgaaccagaaagtattttgatcaacattttggaggaagaattgtatggtatttcccaaccttccccccgtgggtggaattgcatcactgaatcacttttctctatttttttccactttctgtctcctgttttgtcaaggctccagcaaactccagccttttttctgtgttttttagtcctaaaattctagcctggcatctgcgattgtgttagtttcccatcattattttctagcctaacaaggaagcctcgtgaaaacaaagcgttctgtttaatcctcaggtggacgtttgaaccctcgtaaacatgctcccttcacccccccatcttactttttagcaatctcagagatcaaaaagacagtcatctcatccagtgtagacaaagtgaagtacattcctttcatttgcctttgctgtagtccctatttcatccatctaatccgttttaagggataaaattgcaattacaaacatttcatgtgtggtcagatttttagtattttaatctggtctgagacttaagatgaaatgacagttctaacagaggtcctgtgtggaagaaaggacctaggtgccagtctcagtccagtcccttcttagacgtgtgactttggaaaacctctcagagacccatcatctcgtcgtagatggggatggtattacaggtcgtgctcatctgtgttaatcagggttctccagagaaacagaaccaataggagatccacatcgctgttgatgtcaatagatagataggtgtgtatgtagggatggcaggctggagaccctgggaagagttgatgttgcagtcaggaggctgaacttcctcttccttgggagacccaagtttttttctcttaaggccttcaactgattggttgaggcccacccatattatggagggcaatctgcttcactcagagtctactgacttaaatgtccatctcatctaaacggtatcttcacggtgttcaggcaaatatcggtgccacgtcctagtcaagttgacacctgaaatcaaccatccccctcgcaggagtttgtgagcatcaggtgtgaatggtcaggagctgcaggcgtgcacggaggaggccactgttcttcatgcttgagccttttctgtttctgcctcgtttactttccttctctctcctcactgttacccttttcctcctacctctgacacctgcccttcacctcccacctgctacctgagatgggagccacacgtgaagtgagaagaagggagaatgaccaggtgggtgatgaatttaaactggaaagagaacagatcctgatgccagtcaggatagaggtggtctagctcttatgtgatcatgggcaagtgaacatgcctcagtgagcctctgatcagtttctgtatgaggataattatatttatcctctaaaatgaggataatgatatttatctgatacagttcttctgccctaacacatacgtgtgcattgcctttgctttcaaatgtttggtaatcacctttttagatttaaatcattactcaaattgaactctccttcagcctttgtgtgtctagactttccgttaagattagattacttgttttactatgattgtaaaccattgtttccatgaagtctcatagcaaatgttcttttgctttcctcttttgttactagtctcttgttatttctcaaacatatcaagcgcacttctccctcagggcctttgcgtgtgctgtttcctctacatggagctcagatgactgcatgtctttttcctaaacttctttgaggtgtctgttcaaatgtcttccactcaggggggctttccctgagcaccttatagaaaataaataaaatgatataatatctgctctcacgttctgttgcacttgccttgctttgtttttcttcatagtctttatctggaatatatatttatttctgtctacatcctcccactaggacagtggttcttaaccttggatgttcattagaatcaccctgggagtttaaaaaaatcctctcctgtgttctagaacaattaaattcagtaatgttataaggaagagactcagcattagtattttgtaaaactcccaggagattcctatgtgcaaccaagcttgagaaccagtgttctagtctagaaccttacttcccagaggatgtggactggtggcatcagcatcacctttatttgaaagctgagtccaattcttctctttggcaggacccacagatgatgcatatgacattaaagcttgagatgcactgcactagaatgcaggggcgtcattttgcttgctgctgtatccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgaaaaaaaaaaaaaaaaaaaaaaagatctgtgatggaagacacttacagacatgtagacagggtggtgtggaaggtctacagtaagtgactgtttcagactgaggggagggagtagactcctggtgaggagggcaggggcatgtgagttgcgtatgtgagtggctggaacacaaggtggggaggcatgcttgtgtgctttggcaatcacaaagacggttagaaggcagttaaagggttggagtatggtcagttctgtgttttgaagagatgactgacagtcgtggaaggtggattggagaaggaagaccatgggcccatcacacccagtttggagatgattaaagatgatacccacgttacatgacagagccgtggcaggggcaataggatgtaaaatgtggagatcgttttgagatttttcaaatggggaagaccatgtcttttttgtttaaccgaaatgagcaggaattcttggggtgacatcaaattcgatagttctatgagcatatacactgaaaaccacgatattacggaaatataggctatttctcttttcactggcctttagatagactggattagtggagagttgagcattcgtcttttcttagagccttgagtggagatggaccctagtgattatttattttgactgctttattttgaagatgaagagaaggaggccaaggtatgaaatgattatcagaaccaggaatgcaacttgaggtcaccattactagatacatagtgagtgccaggtggtttaaatactcattatcaccttcaatcctcacaaccattgtatgaaacagggatgctatgtttattttagggatgagaaaacccaaaactcaaggaggtaactcacccaaggttttgcagctagtaagtggtacagctgggatccaaacccaggtgtgtcccagctacgctgtgccatctactcctctgccctgctgctttcctaatcagtactccctgatgctgctgaggaagagtcgaacttatagaggtcacacattgttttccttgtttttggatgcagttttgttttctttgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggtggctgacgcctgtaatcccaacactttgggaggccgaggcgggtggatcacgaggtcgggagatcaagaccatcctggctaacatgaaaattagccgggcatggtggtgggcgcctgtagtcccagctactcgggaggctgaggcaggagaatagcgtgaatctgggaggctgagcttgcagtgagcggagatcatgccactgcactccagcctgggcgacagagcaagactccttctcaaaaaaaaaaaaaaaaaaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacagagtgtagtaacaagcaggggtgctatggaatattcatttatcctaaataaatatctttttggcaactgcttttccctatagtgtaatacagtaacgctatggggcatgtatacatgtgtgtgcataaggaacatccgtccatctctagctgtcatgtctgagaacattaataaaaggctcgacctcatgcgcctgcaagtgatcacaagacagttactgaagcattcaaagaagcaatgtctttgtcatctgactcattttgaaaacgcatgagaatgctttcccaaggcaatttcttacaaaatacaccgtgggacatttttcctatagtttattgttgttgatgatcatcgagaactttgtacccagagacactctacactgtgagtgtcccctgatattccctcccactcagcctgatcagtggtatctgacctccaactactcgctgcaacaacccgttctctagctgagtgggcctggactttgaacagaattaacagcctggaagtggagttctcaatctcaacagccccttacctcatgcaaatttcttttgagctgaaaagaacaaacagaatgccaccttttaaaacaaccttcttcgaaacatggggggaaagtcaggttttatataaatcagagagatagaaataaggcccataataaaaaacttgaaatagatttgggaagtttccgaaacttccaaaaactagtggtccaaagtgggcaatattttttgtgtgcattgagaggcccttcctgtttccttggtccatgctggtgtcttgccccgttccaggaaccctgggctcccctgtgctgagcagcccccacacctcagcccaaagcctcaccccttgcctgaccacaccccatttcttttggcacagcttcccagacttacaagatgtcttgaagtgactgaatggagttagtgttcggcaggactggctaggtaactactgggacttggtgcagaatgtagatgtagggctccttgttcaaaaattaggaagaatttcaagatagccacagcagagcattaaaacaaacccaggttggctaggtgtggtggcacactcctgaaatcctagcactttgggaggacgaggcaggcggatcgcttgagctcaggagtttgagaccagcctgggcaacatgacgaaaccccatcgctactaaaaaaaaaaaaaaaaaaaaattagttgggcatggtggtgtgtgcctgtagtcccagctacttgggaggctgaggtgggaggcttgcttttaagcctgggaggcagcctgggcaacagagtgagactgtgtctcaaaaaaattctcagacaagcacaggacctctgtatgactgcacaggtcacaggtcgcacactcacgaagccagcccagtgctcaatactgtattttagaataagcaggaatcagtttagggctgccagacttgcagaacaatcactgtgagggctgatggcagatccctgatctgtgattcagaaagagtcattcagacaggcattgcccagagtctgggttctctctctcctgaagttgttgaggctgtgcagaatgtatgtgtttagtgtttcatccagtctgttagggtaatcagtgtgatttctctggcatctccaggactggaagcagaccagatttaatcaaagctgttgaagctgcccagggactggctaagctgccaccctgttagtgaggccgctggggagagggaaactgaagcctgcaccacggggagccgtatactggagtctggaatccatttgctccacgcaggaggcctgcatctcaagtcaggaggcactgcctggaaatctagcatcatgttgatactctttggtgaaggaaatgtggtccttgccccaagttatctcacagtccctttgggcaatctcatgcatattaaaaataccgacaaacatagacccacgaaagatcctgatcttttaggtctgtcatgtgatagagacagtaagtgctctgtatagacatcaggagattttcttccctgaaggacaagctcttgtagcattttcctgcactgagatgcagtcatgctagcctgtctttcactcaccagggatggcaaggaaggaccagctgacaagtaataaagcaaaccagtttgtaattttacagggctctgaataaagatgcatttatctctggccaacaccaagaggcctcgatgtctctcacagggaggaacttgatgggctgtggcgtcttttgggggtgctagggcagagtcaggcttgaatctgagaaaggcaagtctgtgcattaaaatccagcacgggggtgggtctggggcaagggacaagagagaagcgggaatggaaggcagggatgaggactggtaacagaccctctgcctccttccttcctcttccctcacactggctctttcagccacttccctcactgagataggaagcggtcctgtggtgacgccaagggcacaggcttctgctgtctgggctccggcacagtcattggctctgagtcatccgggaaggaaaggcatcttttaccgccccctctcccaccgtggcctcaggctcccaccatgcaggaaatgcctggtctcccacgaatcagaagctataaacaggactggtggcagttcatacagatttggcaaaggacgagaagctgtgggttattggtatcagtgattatagaaggggaaagagttgatatctgaagataggaaaaggggcttctgaggatggtgttagcatgttcaggcacagcattaatctttaagagtcacgaagagccatcagcacagtcatctccctaataagccttgagagtgttgtcaaagacacttctggatataagtaagaaaccattgagactgagttgtatggttaaacagcacagtttttagggagaggcaaaggcaactctgtgttcagctcttagttctgacacttatgaactcagatttaaattccctgagcctcagtttccctgtctgtaaaatcaggataaaaatttcttgctcaaggccaacaaaaacaagcaatggggtaaaggactccttattcataaatggtgctgggatagctggctagccatatgcagaagaatgaaactgaacccttacctttcaccatatacaaaaattaactcaagatggattaaatcgaaatctaagacctcaaactgtaaaaatcctagaagaaaacacaggaaaaacccctcttgacactagccttggcaaaggatttttggctaagtccccaaaagcaattgcaacaaaaacaaaaaattgacaagtgggaactaattaaactaaagagcttctgcacggcaaaagaatcaacagagtaaacagcaacctaccgaatgggagaaaatatttgcaaactgtgcatccaacaaaggtctaatatccagaatctataaggaacttaaatcaagaggcaaaaaaacaataactccattaaaaaatgggcaaagggcatgaacagacacctcttaaaagaagacatacaagcagccaacaaacaagaaaaaatgcttattatcactaatcatcagagaaatgcaaatcaaagccacgacgagatactgtctcacaccagtcagaatgctattatcaaaagtcaaaaaataacagatgctggtgaggctatggagaaaagggaatgcttatacaccggtgggggaaatgtaacttagttcagtcattgtagaaagcagtttggagatttctcaacttaaaacagagctaccattcagcccataaatctcattactgggtgtatatccaaaggaaactagatcattataccaaaaagacatatacacttgtatgtttactgccacgctattcacagtatcaaagacatggaatcaacctaggtgcacatcaacagtggatttgattttgttttaatgtggtacatatacaccatggaatactttgcagccataaaaaggaatgaaatcatgtcctttatagcaacatgggtaaccatgttggaagagctggaaaccataattctaagtgaatgaatgcaggaacagaaaaccaaatgctgcatgttctcacttataagtaggagctatacatcgagcactcatgaacataaacatgggaacaataaacactgtggactactagagggaggagcgggagggggttaatgagtcagaaactacctcttgggtactgtgctcactacctggatgcaagatacccatgtaacaaacctgcacacgtaaaccctatgtctaaagtaaaagttggaaaagaaaaaatatttcctaaattgttctagaattaagcaaggtaatatttataagacatccagcagagggtctggcaccctggcatataatagatgcctaatgaacattagtttccttatttttcttacgagagtaaaatattaagatgtacatattctgttaggtcatagaaagtttgaatggtgggaaaagtcagctgttaaaatgctgtgggatctctttttgagccttttcacctgtgatcaaagttgtccatcaccctggcatttttgagagctgtaatttaaggaagaaggtatcataggttacctctgtggaaattctagaatttgaatattatgcccctgctcacttgtagactgggctgtcactataaagttaggctgacttgactgtatctgataattaggggctgggagagcatggaaaattgaagccatagataatcccagtgtcttgttttagccaataataattcttctcccaccaagtctttatcagaactgctaacaaggagaaaagtcgactggtttgagtttcctcaccttttattctcccctgggtatcttcagtagaggtgctaatgaacagtgaaatggccaaaaggtgagcagctccagggaggagaagaaggaggctcagataatccacaaactgtaatcgctttgaataattgagttaactccagtaaaatgtagagatacattcacctgctaggcattgttggaagctaaattaacacactggaagcaaagctttcttttaagtttcatttttaatctaatggtggacattttggggcactgcagcctattaaatctgctaactgatgttcagacgttatgaaggagttaaactattctaagaatattcaaggcctgttgttctctcctaggctttctacgtcaaagagtaaagtcagaaaagccaaactgatttctcctaaaatgaagagaattgaagttactctcccaaaccccagttgtaggccaggccctaaactgagagaaatggacaacccaaatattttgacctttgcccattgccaggtgaggccagatccggggaggaagtgatgttttcttatctgccttaacttagccactacgtggagaagcactgtaatgtaattaatgcagaggtgctcaaattctggtgttcctcagaatcacctcaggggcttttagaaacagttgctgggccgttctctcagagtttctgatttggtaggactggggtgggacaaagaatttgcaaatctgagaagttcccggttccagggaccgcactttaataaccacaggtgaaaccaatgagaagctgagctccgaagtcagactacctgggcttgaatctcagatctctcacttggtagttgtgtgactgggtagttgatagtttacagaatctctttgtaccctcgttttctcatttgtaaaatgggaatcctaatatctcataggattgtgagtattaaatgaattaatatgtgataagcccttagaacattccctgctctatggcaagtgtgcattgtaggttagtatgacacggttataggctctctgtaacaatgaatatagtgactgatattttttgagcacttactataggccagagattgactcagtactttgcaaggattatcacatttaatacccacaacgcactctccctcctttcccatgtcctgcttgccttctttcttccactttcagttattcctttttcccttccattctttcttgctcttcaaaagccatattgtgacaaaattaatccattctaaatgaaaaagaaaatgtaccttagttataaagtatgacctttgtgagttttttcaggactgttcacctgttctttgccttttattccagcgtggtacccggcacatagtaggagtttggtgaacattaattacttgaatctcgttatccttaaaaatcaaacagggtttatctatcagggttcccttctcttcctttgtcctatcctggcctctccttgaccaacacattggtaaatttggcctctgctctttcttttccccaactgcaggggcccacatgtcaagacaaggtggcatcaccaaccattgagaaagcttttatttcactagcttctacctggaccacccatcaaaaatctttaaaacgagtattccttgggacaaggccaggtgtcattgagagtccccaggaagagcataggagtcctggtctgggagggccggacctacactctcgggggtgcccagaggaagaacagggcctttaaagtcaccctatgttctctgacccgtgcagtggtggcatactccctcccccacccctgacctgagggtgctgtgtgtcagctctcctaactcttggtctcattagggaagctggttgtcaagtactgcccagttacagttggtttaaactctcaactaagggatcgtaagcaggtcagctgcctgagtctccagttactcttgcagctcaggtttccccttgacaggtcctgataggggctacttttgcaccattgatgtggccagggcttacagcaaggtttaaggtttccatgcgcagccttcttggcaggcagctcccagagaaaggagtatggtttgggagaaagctgcaaggcctgttcgtggatccttagtattttgagccgatcacgtggagtgggcctgtgcccatcagtaccaggagactttatacttaggggagaatctgtatgcggtgtgattttcaagggtctatttcctcattgtttctctttgcttgccctatggctgagtattaaatgaacattgaaagtctactatatgccggttactctgctagatactagcagagatggagggtaggatacaaagacaagtaaggcctagtcttcaggaagcctttatttgtgctctgtgtatcagaagagggttgagttggtgacaagaataaagagttgaggggagtgaggggctgaaaaataataagccttagagaactaggaataaagtgttaacttgggaaaattgttgaaacagttccttaagatatttgtagtagatatgtctctagataagaggcttgtctggctgtgaggtccttgcacgagacccttgcaggtttcccaaatctatttggactgggtgtcctgtattaacatgaaatcgtaggcagacactgaataaatcgcaacagagtttcggttgtggctgctccagtgtcttggagtggttgctccagacacataggtcttatcctcctgccctgaggttctccaaatttgcatttgggaagtgtatagttttatgactgtttcttttatcgtgaacttacggccaccccacttccctgcccacttccccatcagcttcaccttgggtcgcggcacatctgttctccagaacatgttccctgccaggaatctgcagggagctcttaagacttatctttctttttagctgttttttttttttttccactcaacttctaggctagtgctgagtacttatatgtcatgctgtgaatatgtgtgtgaatggattggtcagaattccaaattttagttgtaagaaaattcttttgtgcagcgtgcatggctcaaaatgagagaaaagacactgacgaggacttggcagccccgagcttttccttgggatgttatttgctttaataaattttgacctattttgtaacagaccaggttggagttccctttttaacctgctgtttcaacaaagttaagtgcattgaaggtctatctcaaaggcaatatatattttaaaaatttcagaatcctattctgaggctgaattatggctttttcttttcccataggatttacatgtacactcatctgtattacttcagatgttgctgctgtagtttggatgtttctctccccaaacctcatgttgagacctgatctccagtgttggaggtggggcctaatgcaaggtgtgtgggtcatggaagtggatccctcttgagtagattgctgccctccctgtggtggggtgagtgagttctcgctctgttagttctcacagaagcagattgctaaaaagagcctggtacctccccctgcctctctcttgcttcctctcttgccacgtgatctctgcacacgccggctcgcctcactttccgccacgagtggaagcagcctgaggtcctcaccagaagcagatgctagggccatgcttcctgtagcgcctgtagaactgtaagccaaatgaacctcttttctttatgaattccccagcctcagatattccttcctagcagtacaacatgactaagacagttaacttcccatctgactccctccagttgcttcaagggtaggcaagaattgtatattagctatttctacatccagctgtgtatccacagtgcctcttatatttggcctatagtacatactaaagaaatgtttatgtactctagaaatgtactcaagaaatgaccaaatgaatggataacttggctcatgagaattcttaagggcatttgaaatggcaaggggtatgtttggaagaaggagtgtgaggagctgaaggaaaagaggggagaccagctgtgttcagaacccacagtcatttcctcaggaaacagtaccagatatccttggatgtggggaaatgatccactcttgcagtagcctaggccacaggtaattttgtgtacccactatgcacttagctcatacagtaggtcgtaaaaatgaaaatggcatgattccttcataatctaggtggggagacactataaatacacaaataatttaaaagtacagggctgagcaccgtagctcacacctgtaatcccagcacttcgggagggcaaggcaggaggatcgcttgcccccaggagttcaagaccagcctggacaacatagtgaaacttcatccctagaaaaaacaattagccagctgtggggcatgcctagagtcccagctacttgggaggctgaggtgggaggattgcttgagcccaggagttcaaggctgcagtgagccgtgatcacaccactgcactccagcctgggtgacagagccagaccctgtcttaaaagaaaagtacagattatttcaggattaagcatatgagtacttaggctagagagaggcagagaaatgactcctgttttccagccactgtcacactgcagtgtaagccatcgacacacacatacacttcacttcatctgcacagcctttcaagataggtgtttttatctccagtttacaggtgaggaaaccgagctttgggaccaagttacttgtgcaaatcacacagctgggaaatatcattgccaggatttgaatctgagtctgcagcaattcagagaaagggcacgcacagtggcttttgtgtcagggaagagacattgtctgtattgtgggggtaggtgaactacggctggaacaccagcatgcagaggacttgccttttagctctgaggaggtcgcctgcccttgcatatctataaacaaccaccctggattgagagctgttgaatggggagtttgtctgactcccagaagagagcacagtacaggagaaaccttatataacgcagacatgcccggcatcccgcaggcgggcgcaagccaaccgcacacctcacagacccagcttttgttgtgtaggcgctgtggtgtaaaaaccatcctttagggccctctccctcgtggtggcagcgtgcctgggagctttctgttctatttgtggtatctgttccctttgatcattgtgcattgctttgttcctcatctccctctttggtgtcacctgtgaagtcactggagagccataatcatcctaaagaaagactcagagaagaagaagtaagacctaagaaaacagaccctttagcctccttggagctggttttctagttaagaggcttgattaaaagcgtggggggaatggatctgtgacgtacatggtcatgaaaagtgcagccagcgttacagcacacgtctgtataggttgcatcacaggcagggaagaggcctaagggcctggtggcccgcaggtgtgagcccctctggtggctccatgacaggagaccccgcggagaaagtagctcctcttccttttttaaatttttttttatttttattttttactttgagacggagtctctctttgttgcccaggctggagtgcagtggtgcgatctcagctcactccaccctctacctcccgggctcaagcagttctcctgcctcagcctcccgagtagctgggattacagacacgcgccaccacgcctggctaatttttaaaattttagtagagacggggtttcaccatgttggccaggcggttctcgaactcctgacctcaagtgatctgcccgcctcggtcttccaaagtgctgggattataggcatgagccaccgctccccggcctccccttcttataacacttgaggcctgtgcttcagttcatgggccttatgtaaaggcttctgtcacctgtctactccttcttcaagctggctgtttattcggcacagaggagtaaattacaggtggattatgcagtgacaagcacttttatacctcctgtaagaacagtttataccaggggtccccaacccccagaccgcagactagtactgtccgtggccttttaggaactgggccgcacagcaggaggtgagtggcgggcaagtgagcattaccacctgagctccgcctcctgtcagatcagtggcagcattagattctcgtaagagcacgaaccctgttgtgaatgacacatgtgagggatctaggttgtgtgcttcttatgagaatctaatgataaatgtcatgtgcttgaatcatcctgaaagcatccctctgcccccagtccgtggaaaaatgttcttccaccaaaccagtccctggtgccaaaaaggttgaggactgcttgtctatgccttaaaaaaaaaaggtccatttactttgcagtcatagaggacgcagggctggacttgaggaaatctacctagaaatccccttcaggttaagatttatgacattagcttcactattgaattggatcatagacatctataattaaaggaaaccatttacactttattgttcattaaatgtttaaaccacctgaaaagatttttttctaattgagcctttttgcatagttaccagttacccgtatctgacttcaagtctttagccgtatacctacatggttccatagttatcaatgtttatttacaatttaatattcttctttagcattatttaatatcaaaatgataatatgtactacggtaggttgggctttacagcttacaaaacactttgacatacattctctattatttttgatggctctgtgacatactgaactgaagcaacagtttaaggctatttctaaattgggctctgctcaagtgtgagaaagcgtgacagtcaacatgaactagctttagccttatcaccgtttcctgctcaggcaggtaagatctgctgaaggaaggaaccgttgccaactggccaggtgtgccagttcgtggcctagaaggggcagctgtcagttgaactttgcccatgttttcaggattttatctcaactcctgagtagtctcatctgggtgggagcactagaattgaaggcctgttcaaaggttttgtgcctttaactggagaattttttggaagccccttagaactgccaggcagccatgtgggatcaggtgggggggactgggctgctgtgtggtagatttgagttcatgtctcataaatggactctccccgaatctgagagggttgctccctaagtcaactacttaataattaatggaaaggagatgtgacaggaatagccaatttccctgtcctgtttggtatgactgttggcaatttgatgattccttccttaaccttgaagcaatctcagtttgactgactcatactatggggaagatagtggcctttgaactcttgactcaatacagtcttgaccttggttagatactaccttgacctctggataaaactgtactgggcattactattttattgattgttctctcaacaaaacaaccgtatctttaaaaaatttttttatcttacatgtctgaagtagaaggtcacctcttttgtagtgaaaaaataactattttccccatggtgtgctgaatgcatgggttaaagcaggtagaccagctgtcctgggttttatccctatgtgttttttgctgattcacaaaggcatttaatttctctctaccacgctttctaggtctgcaaaatagaaaggggagttcatgaccatctatgcgttactgggggatttttctgtgcaagcgaaaattattgatgcaaccagaggacttgctgccagcgtcgaggggtgcattttactccctctgtaaagaggccagcagtaatgatagaaacacagtgcatttgactctgaccttatatttgacaactcttcctctacaatccttaaaaaacatgcctcaccatttaagagaccagcagcaggccttcagcaaagcccacggtctaggcagcctttgtaggcctctgggattgtggtgagaaaaccttatccctctcttatttcctgataactttacattttagaggtgtctggaaagaaaggtggcagaaaagcagcataacctgcttgacaagtcctgtacaaacagaagtccaatgaggctgctgctctggggttgccaagctcaaggaagccaattgtagtgtgcacaaaggtgcaagtcaccaaggcctcagagagctccaaggaagcctgtgcaaaggcaggatttagagttctaaggacgggttgtccagcgcagcccagcagagaacctaggtccataactgtggactctcctgtgagggagccatgttgcggggtggacatctgacagttgtccctgctctgtgaacctgcgacttcatcctacaggtgcagagaatggttttggcaactctctccaccgcagaatgtgggcggacttctgagctgggtttgattttcctcttttgctttggagtgtacaacaatcaaccctttagagcagaagtagaggaatggaagactttcccatggcccaagacccctcagtgggttgctgtttgctcttccctagaatattataatgttcaatttatgcctccaggagaccagagacacacgtttcccaaatgtgggtacaggtggctttaagctgtttctgtgagtagaggcccagtgacatgttccccagtgtaaccccctccttggtttcacatcccctctacccgattctaggccaagcccctccagtgtagttggtgacccagaacaggtgaaagtgaggctgccttttgtagcactgctctttgtgaatgggaagtgctgctggggagaaatgattttaagtgtgagctttgctgttaggggcagccctctttctccactgcaataagaagagtcatgactaagtctagaaaggcaggttttgatctttaggatactgtgatgtatgaaataaaggtatgtccttcttattcggtgttgcattgtcagcacctaacacagtgtttaattaaagcaaaaatttttgtattgaaaatataactaggtggaggagtaagtcagtgctacttaagtgtgagtatttgtcttccctgatcagatggttttctacgtactcaaaatttcatgtagtaagaatgcaggatgcttatggagaaaagtgagtgttgtttgtttctccttaatatttatatataaaagcaagagcttattaaacttttagacgtctttggaggtttgaaatttcccactgttattcttaagaagagaagagaaagaataattttttttcttctgtcttattggcctttaaggaaaagcgaatttcagaaaaacatgggacggaacaggaagtgtttacaggtttagtcatacttgttaggtatgaaaaagccccactgccttctcatattgtttcttttatgaacttaacacttcctactttgagaataccttcctccccaagggctcaaagcccttcatagtcattaatttgcatcttgctaattttcttaaaaaattaaaatgttaactaccatttagctggtattctaccagctaaaacttccagctaaatgcattttgtctgtctgtatgtattagctcagttgaaaatgtgatcctactgaaggcagtagggtaaccggcttgtcccagtttccctgggatttcagttttagtactgaaaaccccacatccccggaaccccttcagtcccagacaaaccagcatggttgggtcacccaagaaggcgaccagttcaggtagctctgcataaagagaagatgttccaccctgcagtccttaccttaaatctaggcagctaccttaagaattgacctagacagcagtgtgtgcatggctcagtgcaaatctttagcatcacctggtagaagacaacactgagcacacagtcgcagaactagtgcagttcgaggtacgtggaaatgtctctgcaaagtaatatttctggtttcttgtttttttgtctacccttttcccctttactgcactatatggtgaaaaacgaaaacaagaactgctaactacctgatttccgaaacaagaagtgtgatctcaaatatttctgttgatctcaggtttttcatctgaaaaatgaggatgctggtctcaatttctaaggccccttcctgcccaaacttaccaggaggaaagaagctggaagtagaaagcaggagaggttcaaaaagaaaatgggatgcatctcctttagtaagctctactctggagaaggacgttgtccttcaagtacaaaccttttcaccgacttggggagtttccccccattgtatcccaccccatctttttctgccatcgtgcactgtgtcgtttgaatgtgctgctttgtcagggctgggggcttccttggtgctccagcttggccacatccgacacacagaccaccccgtcctccttctgcctctagaggaccaagaacaacccttgttctgaaagcaccctgtccctgagcctgaacacatgaccctggatgtcagaagatgctcttctccatttcaattgcccaattccagctctgtaatcattatgttaaatgatacaagtttcaaaaaatatatatttctaatagactttctattatcttccttaaatccacagtgtcactttcattcttactcctcattttggggtgaaagtgtagaaagattgtggctttagaatctgacgtactttgcttcaaattctagcaccactgtgtgacattgggaagcccgttctttaaccccactcagactctgtttctccattgatgaaatagaaacatacagtatcttatgtgtctggcacatggaaggtactcagcatattaatattaaccactttgggctgggcgcagtggctcacgcctgtaattgcagcactttgggaggccaaagcaggcggatcatgaggtcaggagattgagactatcctggttaacacagtgaaaccctgtctctactaaaaatacaaaaatttagccaggcatggtggcaggtgcctgtagtcccagctgctcgggaggctgaggcaggagaatggcgtgaatccgggaggcagagcttgcagtgagccgagatcgcaccactgcagtgcagcctgggagacagagcgagactccatctcaaaaaaaaaaaaaaaaaaaaaaaaattaaccacttcattcttcttagcccttcaagcccccgcaccgtgttttctgacatatcatcttgttttcatcctttctcttcggtttaattccagagggtacagagaaggtgtaagttacaggtaaaggagagtaagtgcactgtgagtgggtgctgatgaaatatcacaacaggttctcattctgacaactcacactaggccatgcttccccggaatatttatggaactaagtggaaaaaaggatctttagcaaggatccagcaccctcaatgcagggaatgaaatgtgtttattattagagcaatccagtttccatacagctaccaatatacacacacccacataccctgttcagccatactgaagagtttacttgtaaatccaggcgaagctgatgctgagaggtggcccgctgtactgattttgtaaaaccagcaggaaaacctctgctcggccgaccacttgatgttttagttgcagccactaacatgttaatcaaaagaagcaaatacatgtttttcccttgagaaaacatggatagtggtgtaacggaaattaccttgaattattcctcctcaagtatctatccaatctagatagatggattatctgattgcaccaggagatgcagacctggcagtggctacttctattgcagcatctttaaaggaatcagatctttggatttccattttcccatttttattcttattttctccctgctaaaaaacagtttgcagaggcacttgaaagtgatataaactccatagtagataatagttgtacatgaacatcgtatcttttatcatatagtcccctatgtaattaggtgatagcttgagcctagcacaggtggcgctgctgagccatctcggaaatgaccacatctgaactgggcgcagtggttcatgcctgtaatccccacacttcgggaggccaagatgggtggattgcttgagctcaggagttcgagaccagcctgggcaacatgacgaaacctcgtctctacaaaaaatataaaaattagctgtgtgtggtggtgctcacctgtggtcccagctacctggggggctgagatgagcaaaaaaaaaaaagaaaaaaaaaaaaagaagaagaagaaattaccatatctgtatgtctatacataggtatgtggatttatcacagtgctggtacaagtacttttgtcattgatgtttattaagctttttatgctccaggcactatgcaaaattgtagggcattatctcctctaatcctcagaatcttatgcagtagggccggtgttgctattactccattttatagatgaggaaacttaggcttggggtgtttaagtaacttctatgaagtcacacagtaagtgctagagccaagaggcaaagtaagcctggatgcttccaagccgtagctcttaaccactatgctatactgctcaaaaatatttttagaactgaatgaagacatctaaggaaaaggaaaacgtggtccctaatggtcttttgtgataacaatatgaaacctttcgtctctaaagtgtcatggaagtgaaacttgaaaggctctgttcttcatcttctacttattaatgggcaaaatgtcttcgtaatttatggcatgtgtcccaaaggtgcaaaggtggcaaggtggccttttttttttttttttttttttttttactaatactaggtcctgcttccaagcctcctatttcttcacttccctgtgtaccagggtttacctgctgcttaacccacccaccccactatacgtgtctgtagtagacccaccaacattcacatggccacttctgctgaaagtacctcccaggatagaatagggtcacagacccccaattgtataagcctttggcttcttgatgtctctgcgagttacggttatgggagttggtctttggtgagattagtggtgagatcagtgggtggcacctagggtgatttattgaatagtatggggtgaggctgaagagcaaacatccacgtaagtgttgtctgttttggagtttgaaaagttgtcaccctaataaacaaactacttaattgaacagcccttgcttggcgtgatcaaagaaaagacctagactttgctatcagtaggctctgggttccaggcctggcttgtcacttacgatgatgatgatgatgatgattttttatttttttgagatggagtttcactcttgttgcccaggctggagtgcaatggcacaatctcggctcgccacaacctccgcctcccgggttcaagcgattctcgtctcagcctcttgagtagctgggattacaggcgcccgccagtacgcctggctaatttttggtatttttagtagaaacggggtttcaccatgttgcccagactggtctcgaactcctgacctcaggtgatccacccgccttggcctcccaaagtgcggggattacaggcgtgaaccatcgcgcccggccagctcgtcgcttattatgcaagttgtataacattgctgaatcccaagtttttagtctttaaaatgagaatttaaatgtcgcccttattttgattgctgggaagtttaaatgaaacagtgtatgtgcctgtcacatagtagttgacaataaatgatagtttcttttccttttcccttaagtaagttttttttccctctagcctataagctccttaaagaagatagagattttcttttctcactcatttccatattctcagcccttagcagtgccaggcacatatttgctgaatgaaagaaaaatcttttacaaaggtcttcagatcattcattcaccagacaattgttgagtatctacagtgtatcaggcactgttcttggagcagggcagtcttaaaaaacacacacaaacatagtctgtgtccccttttttagtctaactgggagagaaacattacatagataattagagcaatgaacaactttgatccttgagatgggatttaaattttaagagataggtgacatttggtgtcaagtctgtccaggtatacttgatattgtttttgatcaggtacaagaaacggcaatatactgttatctataactggttctgaaagatctgaaagaggtgtttctaaagtatttttgaggaatggtgctgcttttttggaataagtataaatacattgtaaagtatctatttcgagagggaacagacttgatgggatgggatcatagtaggtaaggtgttccaggaacttggaacatactggaataaggcttaaacacaagtcacagaactgggtgatagggcggtgagcgcatctactggagaggagatggggcagggctggcagcttgtagcaagatttttatgtagacagttagacttcaaacttcatcagtaagtcagtagatggccctaggtggaaacacaggacaaaagatgaatttgtgttggcactagaaatactttgagctcatctaatgaggctcattcattcatttggtaaatacttcacgagtgtccagtgcaagctctgttctagttgtaagggatatggcagtgaacaaggcagacaaggtccctgtgcctgcagagttttgatgataaccttcccccctgggtgtgtgggagggcctggggctcctgtgtggtttgggggtctgagaggtggatgaaggtacagtaggcccacagtcgtggaaatcaaagtccaagctccagtgaaccatcaattaagaaacaagggattgtgaagaacaagacctagatccagactgaagggaaggatttgctgaggagttcaggccagcatgggctggggtgacttggcctggaactctacaacagtcaggacagggagtcctgaataggggcacctgcagctgagtccatggatggggagggacctgtgtaaggcactgaatttagactctgcacgcagttctaagaggtgttctcaacacgtttatgcaactaaaaagtgtttattaacagtgttttgaaacaagtgggatttttgttgaggttgtaggataattcagggtcatatggagatttttattctatcagtatttgccctgtcatgtagatgagacacgttagaggcaagcctctgaaaattagattgatttatttttctagtctgaaccgaggaaaataactacttgtcttctatctcctggtgctctaatatatgtaaaatgttgtcttatggtgagacaatgcatattaattttttaggcacttgatggaagaagtggatgagggaagcagcatcggtctttgaacctaggtcagaaagaaatggaagccatggtgtgagaataatgcatcatggtttgtatggcctttttcatgtattttaactcaactgattttctcagggcctcatcagtcagtcaacgcagttttctccatctcatagccaaggagactgagactcagatctgcccctgcccactttttttgtagttttagggggaagcataaatgtggaggaagtaaatgagtgtgtttgttcaggcttagacttttgttattttttagccttgcagggaaggggaggaaagccaataacgatggctagaattggagatagaatgaatgcaagttgcattaaactgtaaggttagtctcggtaagaggttgtttatatggtggtgtcttgggtgtatcttaccatgtagcattcttcgttttaagaaggattccttccggtgcaacatcagtcacagcatagaaagcctatgctgctctgctagtttgcttgcttgcttgcttgcttgcttgctttctccttccttccttccttccttccctccctccctccttccctccttccctccttccttcctctctctttctctttctctctctctctgttttttgtttgtttttgctttttttttttttttttttttaaatttgagacagggtcttgctcagtcagccaggctggagtgcagtggcgcagtcatggctcaccagccttgcacttcttgggctcaagtgatcctcccacctcagcctcccaagtagctggaatgtaccaccatgcccgactaatttttaattttttttaatggagacggttttgccctgttgcccagactcatctcaaactcctgggctcaagtgatcctcctgcctctgcctcccaaagtgctgagattacaagtgtgacccactgcgcctctgccctgtgccacttttccacagctgctttacctacagcctgggagtcaggccagcaaatgacgacaccccaggcacagacatgctctctaggaacttcgagtcaggtatttcactttgtaaagaacttccattttaattctattttctcctagttagagactcatctttcttctgaggggtgcaaatgattctttggagaagtttaaacctgttttacggttcaaactcaagatggtagaaacaagtcatatccaaaagagtgccccgagctctaagagttgtggctgcgcaacgttttttaggtgtctccgaagtgttatggccaagttcaggattgacccagatgaggagaggttgcactgcatagtgatgatttgtgttggggaggagagctgaaactttgcaaagtggcgtcctgaaccaacttgtttttcagcttctagggaaatttgttaggtaatttttaaaaaaagagagagagagacagagaagacttaatttgatggagcctaaactccactgtcttctttctgctgagtgctaaggggctcatggtctctgaggacagagggcaggaaaacaccttcatgccctgtgtcctctgtaaggggcctctagtatgagggactctgatgactattgctgttggggaaaagaaggaaaaggaacaggggtcaacttctgtcatcatctctccagagtttatgatgtttctgaaaggatggggaatagtgcgtggcccccactcatccctgtgaggtgctgcccaggtatccaacctgcagtgcacatgctcgccactggcactggggatggtgagtgcagcagagagatgggattcttaatttattcaattttaattaaaaaacacagttcagttgttaaaaacctatttaagtgtgtttggaatagcttggatatgtgaatttaccttttcaactgtgaattttatgaactctaaatacagatcaagtatttccagcaaaaatttagtgtcggatttgaaatgtgctctaatggaaactagacaccagatttcgaagacttagtatgaaaaaaacataaaatacctcagtaattatctgtattgactatacattgaaagaatattttggccacattgagttaggtgtcctatgttatttagatgcattttacccatctcttgtttttcatgtagctaccagaaaatgttaaattacctatggggctccccttatatttctgtgggacagtgcgagtctagacagtgccttacgggatccatcagaagcattattggactttctagggaaagttgctggacttcaaaagttagagtcataatttttcccgttgtgttaacaagttgctttatgtggatgggtttatgacaattgagggttggaaaataggttttaataagagtaagttaattgagaggacagctttacctctgttaatcagaatgattttaaaatgcattttcacccactcagaaaccactgattctcatgggaacaaaaaactacattcgtgcgtagtacgaatttgtgcctgctgggtccttgtacctttacgccaggcagaaatctccgtaatcgtcagtgtagatttcatttccttgtggcaaggaatataaagtaatacaaccaaaggggaattccactgcatgaaaggaaatattagtgctcgtctagctcttgtttcaaccctataagctccaagtgattttcagagtccctccttcaacttttttgttaaactttccagattttcctatttatagatttcagttgttggcagctacatgttggaaccgttgttgaagcccctagtaagacttgatgctgtagcacgctttcacagcttggtttgcaagttgctttctaaagatgcaaagagaattactacccactctagtagtttgaacaacccagtgaatttcagatattaaagccatattcatgccactgttctcctaattctatcactgtttagaattgcattttgtctaaaggaaggatagatagaatactactaataatatcaagatgctcagaaactgttgagaattttttttacaggaagaacttaaatttccagaggcttttaaaaaaaaatttattaaggaaggagtaaataaatacgccgggttcttgagtaaactacttttacccttcagaaccactttgtacgtagactttatcatgatggccaagagtttttaaaatactataggcagagggtatactctagagaaagaagacaacattgggtttaggactgctagccccatccagagcagttatgtggttcattcagggatcttcttagcccttcaacctcaatttctacatctgtgaggtaggttttgtgctagttctagtgacatgactcgtgggtgtattaggaggatatagcagcatgtaattgaagggcttttatcttggaaaagccttagtaggctcaaggtttctagttgtttagggttctaagattttactaactagtcagctgcttggagttcaaggcatttcttcagattataatgagttgatagtgcagtgtgcaaaaataaagaccgaaccatggtaagtagcaaggttactgtaaggaaaaaaatgtgtcccactggcccctttaaaatggcacaggtgcatctctgtagcaaccttgacagccatcatgtgggatcattcccctcacccagggaacagtggttccccaatctccaatctctccattctccagcatgagaaagtggtctggagcttgatcacatgaagatggacagacacagccttttggatgcgagagagggaagggaatgcaggccaaaagtggggtgggttttcctttcctcttccttgttttttattaaccttgtcttgctcctgccacacacaagtgcagccagtgctcaggacactgctccgtgtggagctccggaaagtgaagctgagaagccttccttggggtggacatggggggagctgcagaggcaatagggagaaaataacaaccatggctcaggcactgcttggagcagttgttcatatgtaggtcaggtagtcatcattcaggaacttcctgtattacacaaataatctctattttatggttaaaggtaggacagtgataatttactcaggagggaaggacaattagcaaattgattaataaggtttctaaaacctattgtgaaagagaatcctttaacatatgtcttgatttattctgcttatttatgtcttgatttaagacagtgattcgcaactttagctctgcatattgcaatcacctgggagctttaacagcgttcatgcctggctcccatccctggagatttacttggctattgggattgtgttttaaagtttctccaggtgattctaatacacagataatagccagaatgcctgatttaaaatgtttcctgaattgttagctgatcttgagtgcatattttctatgtactgttgcacactaatagttttaatgaaggcacagaatcttatgtaaaataaactgttaattggtcttaactacagggctacaagagtttccttcttatttcaagctgcttaatattccgttaatcactgttgtcatgcacacacacttctgtattccattctcattcatttactttttagaatggtattaatgctggtggcatttgcagggtagtagtcaccttgtcagtagaacttgctttagtaattagttgtcagaaacaaaactccccagactttctacccatgaccacaatgaagggaatgatgccttttctgagtccctattcctaagaatcaggaaatttctatgatatttgacaagtataggtagaaattacttgccaaggtgattatgacttctggaaaaaatttttttaaaggaaacacaggtgtgtaacactcctaatcagtatataagattgtttgtatgttactttttcgagttataaaaggaagaggataaattctgcctccttccccagttactgtcaatcttcagtcttcttttgaattaagttagtttcccattttacaacataaagacaagtttaattcttaaggcttacataaaaaagtaatgtttaatttgggatttctcaaattcttcatcataataacaccttgcattagtagagaacctttgttgcaagaagatcaaaatattttataagcttcatctcatttttcttttctttctttcttttttttttttttttttggagacagcatcttgctctgtcgccctggctggagtgcagtagcacaatcacagctcactgtagcctcaacctcctgggctcaagtgatccttccacctcagcctcccaagtagctggaaccacaggcacatgccaccatgcctggctaatttttcatattttttgtagagacggggtttcgccatgttgcccaggctggtctcgaactactgagctcgagggatcctcttgccctggcctcccaaagtattgggattacaggtgtgagccactgcgccagacctcttttatctttgagataataccgtgtgacgacaaaggctgggtattgttatccgaatctctcacacagcaacactgaggagacattgactcatttcttttacgttgctttttaagtacagtattgtttggttttgttgaaaattattttggtagtaaacattttccagagatataaatcttttccagactcatttgcgcttgttactgtaggtagaattcatgaggcttttcctatttctgtttatttcggagcctgaagtgacccaggaattatgtgatatatgtagagcgagggaatttcttcagtttgactgtggtcctggttgtaacccagccttcttccttacagatgggggtgagggttggggtatcccttagagcctggtgtgtcttcatacaaacagctttgctggggctgcctagagcctgggccagcagtggggtagtatcaagtacagggcattattcagcggttctccacactctcctcatttgaatgagaatataaatcttctcccctggctctcatgtcacatctttaaaacctcaagtttcttattaggcatgtgtggtccatttaagctctagacatttcgaaaagataaatcacagggcaaaacatctttctagttttgaaggaggtctgagttgcagctcgctggggttgtgagtctgagccgtcgcttttctttctcttccttttacaagacttccaggatatagccgttaaagaaggacacaaaaaagagcaaagccctcagtgatgctgtggcacaaagaagaaagctacttgaggaggaggcgaagggtttacgaagaggcaaagaatgcaggtgaagggagggaggagttaatagttaaggctcaggttccaagccctttgggctgccagtgtctgcaggagccttgctttcatcctttccttctgcccaggttttaagtctcatgagttaaaacctggggaagctcccaccccaggtccactgtgagggaacgtacaagaacagtcacgtggcaatagtacatgcctggaaggtatctctcatttggggggagattgagaagcgctgtctaatggtgcccttgatacaactaaatagcaactgtctcagttcattacttgttagccccaggcagggacaacgcagattggctaattataatagccagaccattaaagggaatagcattaatggaggagaaagcagctaataaagagctgaacttggccactttgttgtgcccaggatacaagctgctgttaatttcagtacctgtttcttctgctgttagaactaggaagaaaggatttagtgaccctctttcaaaaggtggatcacaagcttagaggcattgctggataaattcaacagcaagactttatttcttccccagaggtgacgtctgatggttctgtataaataaagtcacaccacctttcttatgctgaattgatgctgctgacctgctgttagtaggacatgcacttttatggcgtttccaggagtggtgatgtgtgttgctgagctcatctaatctctgctttgagcaaaggcaatcctctatatcatggcagggattagaggtatagcctggggctgcagaatggtgtgatttaaattttcccatgcaggttcaaagcttgtaactttgcctgcgtgtacatccacactgggttccagccacatgaactgggccaccttcatagacctccctggtaaccacagcctgacgtgacaaggaatcacagttttactttccgcttactatccatgttagaaatatctaaggaaattcaggaaaaaaaaaaaagagagaatttcatggcatgtcaagaatggaaagtatcttaattaaaatgttttaaaatgggaacaataaagaagtcgatttaagttttttgctttggtgcttgtctttaaagaaattgctcctaattctagaaactagtgctttttctaattatattcagtagaaccctaggatcctgtgaggaggcataggggagtaattgataaagaaggggactgtggtgtccgtgttttatttggagctgttctacccacactgtaatttataagctctaacttaccaggggagataagattgtatagaaccagcatcttgcagttatacggaacctttaagttctcctactccagctccttcccagtgcaagcacgtgttttagagtaactgttcagcctcagcattaagtcagctttaggagaacagtaaatcgcccatttatctggagacttcagctgtttgaaaggccttccttctagtgcatcggtatctgttgctggctctgtcctctgctactacaagcaagccttgagtctctcttagacttgtccttcctatatttgaagacatctccgagaagattttaaatcttttttcccccacaggccacatatatccttaatgccttcatccattcccctcttgggaatgtgcatctttgggccattggagaggtcttgcttggactgcggccactgtgatttctgggggcagactcagctccttcttggtgtagagatctgcccactataggcaccaaatagatgttggcaggcttctttcctccttactgcttctatttatctcacctgtacttttagatttgctgctcttgggtaagcagataagaacaagggaaatgtcttccgttgttgttaaagacaatgttaggatagaaagtaatatgtttgtactcaaaaatgcccagtgagatttctagccacggccaagttatcatttgcataagcaacctggaaatgccctcttggtcctactgattgtgtcccatggttaatgtagatccctggataaattcgaatggctactcctgctcaggggtcatgccatgagaacttttctcatacatcagatagagtccccttccgtcagctgaatgcatttacccctcagtctgtgctacccataggataagcaacatgcataagaaggtaggtgccttggcttaggcagctctgttgagtcaccctcaagaatcctgctggaattctgtgaggagtgaggatgcagagcaacgaaatattcgaaggctgctatgatttttacaagcttgaacctgtctcttggaattccccattgtgaagtcattgttgactggttggcattataaagcagttcagagaagtaaagttagatcagtctgcacgcaaataccagccacaccatctcccaagctagtgactggaactgcggttttcaagtcagtttcctcattgcggaatggagataacgatgccttccttgcagggtcattgtgaggctgaaataaaataaaggcttcatgggaacacataccacatgctcacttaatgctagctctctttcctgattgtggcagtgactgtattttccagctacaattgtgacacgtgttctgagaggtgttaagtatttatatacaactacccatatgtatttatgggtaaaaggacacggaactttaaatattgagaccatcctggaaattctaggatgtatgattgcataatttgtaatgcctgctataggcctagcctcatagttgacccttgatggatgctgaaatatttcttaatcatagggagaaaaaaaactcaatgaccttttacagagatgtttgattgcagggcttattgctaatgctctctctctctctttttttttttttttttttttttaatctcactatgcaaagataatacaggtctgggtaagaggaagacttaagatgctttgacttaattgtatctgcttgacagaagcaatatactgccttctgattttaggatgtaaccatccagaaaggcagaagaaagggacaatttcagttctaaacaggaatccgaatatctcacgtcctgaaccatctacataaactagagaaagggcactccttaagactggtgaagcgggctccttggaagatccccacagcaacattgagtttggtttgtctggcgtaccctctccccaagggctgagtgggccatctgggtaacctagagaggagacttcagatgctaggagtatagttcctacccatcctcattttcacagggtacactcatttttttccccttggaagtactgatatgtattctgcaagatgaatgttgagacccaaacaccatttggcttgtaaaaattaatggcttagcatccagagggatgttgctttcagggcaggggggacactggacaccaagaagaaagccagcttgggcccctataccatcttggatgtctaaaccatcttctggtaactctctggatgaaaagaaatcatgaacttcacttctgtgatttggtggatgtggattttgctacatcaaaatttgcatttgagtctctgtggtgttctttctagccgagatgctagggtatgctctttctttctggggagattccaaaaatgttactctctgtggctgtgtgtacaatgtctatttagaaaagaagactggcatttgcatcttctctcaaattctttacgtttgtctcactgaattttggagtggacaaaatattcaatagcttttttcaagtgaaaaaaatgtcgactttcaagagtgtattactttaggttcttgtgtatatctgtgctttcctggtggcagaaacctagaaaactctagagctcaaatttcagcgtattcaattttttgttaatgtgtctatagcttgttaataaaagcttacttaatgaaagccaacatcaccaccacttgaaatttttgcagccagaagagtgtacttaaatacttgtgtattcagacttcactttaataaatttcaataaatagcttcccataggagaggtttcttctgttgaatctgtagaagttgacgacggtacaagcatcagctttctcaggcagcttttctaaacacctgcagggtggaaaagagatccttctctcaaaatactgaatattgctggcatgaccactcttgtcactggtgcctgctgttttccatcttatctgggttgcaggtttcttcacagtgatgggacaccgaagtgcaatgggatgaaagcatgcctgtggcatttttaccctagctgtggggaaatgaccactatcctgtgtccatgacactcttcctcctcaggactttcaaactaggcttcagaagccatcactgggggcagtcctggcatttataatggggatagggacaatttccaggaaaagtttctatatcaaggacatctcagttctgcagcagagaaatctttgaaattacctgcaaaccatctttttgcaagcacaaccaactttatttctgttttaattaattccaaaaatgctttatttccagaatgttaatatttagttagcagtaggctctaagtttcccaacccctcagccttttcagagggtataataataaatgtgtaaatgtgctaggggatccccgtgatttatggaagctttatattgaataattttgaagaggaaagaccttttggtaataatattcattttttgactcttctgtaatatgcaacctgagggtgggtgtgggggaacgtggagaaatgccattctcctactgagcacagactgtatacacctattttacagggaagtcacgggctcctaagcattcagtttaaaaatgagcagaattagatgggtacccttcattggcccttcatggctaggggagaaatgggagagggaacgcagctcattttggcttcagtccttacgctttcaagagacaaccctactccatacttcattattttttttaaagctttctataatggttggtgaaatttacatttcaactcttgcctacaacagttttctgccttattttctcttcccagcgctttgtgccgcctccttgacaacctgctcataggtattacaattggcctcagaaattgcagtgcttcccttttgttcagctggttggcttgataggttgtatctgcaaatttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgttaaaagaaagaaagcagctctggttttcatctgtctgacaatttgctttagaggtgggactctcaccaccaccccctcctttgttggggtcgcaccagagaagcagttgtgagagtaaagaggttccctttatttgggaaattagacgttagtgtccttaaacttctctgtctagatgtctccatctgagatagtggtatttggttaatttttccaattgctgatagtctgctgatgtgccagggtagatgttaagtgcgaggttattgcaatagagtgaaaaatgagcactgtgagagtcaacctagagattcacaaaaagagagacaaaaggagtctctgtagtgtgggattcccaagagtgtgttttgttctccttggaacagagcccactcactgtacagcatccttttggggtccccaagtgctctgcagccaccaagcccagagttaccttaggtgtgccatggctactagaagagtgctcggggccctagaagcacattgtgcatttgtccgtcttggtcaaggtaacctctcttgttgctgacaagtctcttcattgagcctttgaaaaagagcttatggtgtggaaaactgtcctccagctgagtagaaaccatcatcaggaatgtgaggagatcagtgggccacagtctcttcatctctggccttccttttataagttttcatcatgaaatagcagttgtctccatctaaaattgtttggacggggtttgcgggggatggcgtcagatcccagagcaggtgcagaagtgtggtgtttcaccgtaaggtcagggaaccatgtagaagtgaaagcacaccaaggggttacttttaaagagagcacagttgaaaggaaggtccaaagcaatgataatttagtaaattacagtatatacactttcagggtaatagctagccagactcttttgtcagctggctggggatggagttcctaagaaatgaagtccagtcagcatggagggccgggtttctcccagcttgccttggtggagttggggcaggcggggatgaggcggcctcactctcatggactagccagagtgtcttgtgagtttctctttgcttcaagggaaagaagagtcattgaatttcgaaatgctgtcttgtttttttcttgcactcatgaagcaccatttgaagaccctttggctgcccgatgttttcttcaccaagtttcacttctgcaaaaaccctaacaaaacagaaagctatttccgagaataaagttaacggtagatatctagacatatagtgggatttggggggtgtcagacaagagttgaagagtatggagaatttgttaaattctaaaaacagactgtttgaaatgctcagaagcccacctcacctttaaaaacctctgaacagattttatgtttcctatatgtgtgggctttttttttttttttttttttttttgcttttttcatcccaaaccaaacaccaaaaagtataacccatccttcaagttaaagtttctcaaaatacatgtgatgcctgctaaagttcaagaaaagtgcagttgaaagttttgcctctgggtgactttttacaggacatcttaattgacccagaaatgaaacctgggatatatgtgcctgcccttcattaagaaattcaccaagaaacctcaggatgtatgtttaaacagaaatattccaactgccctacttgcttctggtgggtgccttagggaaggtatagcaattccattcggaaattataacaatatgtatatattcatttaaaatcaaaacttcctaccacaactgccagactttctaggctatgagcagaggagaagctttaatttggttataggccgaggactccgccgcttccctttgcacatttgatgagatgtaaaatgttaaagaactatctttccaaaacgtaaacactgccttccctttacttaaatgtacgattttcttttgctcttgagttttattttcatagtggcatcttactggtctttcctttccaccatatttttggatgttgtgtgttccattttacattgcccagttaaaccacagacactcctgaagtcatgtttacatgtggactgcaagtcaacctagttggcatgttgatctaagctacaaattgcactgctgttttgccgaacccaacagtcggtttcttgccattatttgcggtattttaacttaaaactcacggtaatccttctcaccccatctagtttgttttaattgatctaacaaacactgcttgtttgaattcaaatggaggatccatggaagctctcccaccccaccctttgatacttgataaggggtcaaacagtacttcttttaaattcagataattctttgaatgaactatgaaatacttcagagggaaaggaaatatcgattctgagatggagagtaaaagaacaaggagatattcattattgttgcagataattcctagcaatgaaggaaaaaattagacgttggatatttttggttgtggtggttgtatagtgagataggtggacaatagaaaaatcttccttgtggattgaagttctaaatctagaacttatctttgaagctgtcactttacttgatcagctcactatggaagtgaatctagaatcatactttgattagaagctggggatattgctacagaagagaaaacatggctttaatatagtgatggcattaattatgtgacttgggcaagtcattttttaaaaagttgtctttaagccattctcgcggacgtattttttttgttcccttttgtccctcctttttacttgtacaaaccacagggtgtacacctattgacatgagtccaaagtaaaggctgttttcaacgatggcagagttttgttatatagccccaaggctaggcatctgaaagacaactgtatacagtgtctctacggagagagtaagccggattgcttgggaagctggtactgcccatgccccgcctcccttttgctccccaccccgagatggtctcatacctccattccaagctttcattgtctctctccccctcccctcttcctgcccttatttttaacagcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctctgaggtggttttcacaggacttcgccacgctgctttggaatctttcacacccccctacccccagatacctttgaaaaatttgaggttcctgttccttgtttctcagtgtattcatttcttccctgactatgacatgttaaaaaaaaaagaaacctggaaacatgcagtatatggcagagccaactaaatctcctagtagacaagatgatttctgtgtgtgtgcaaagtttatctgtattctcaaattcacgcttactcaactttaatattttctttggtcctaaattttgctcagtttgtgagtcagactcacttctgctttgtttttaagctgtgcgctcgtcctttctttccagggccctccctcccctccctgtctgtgctggctacttttcttcccttcgttttctaggcctgcataggtcctctctcttgcctcctctttccttcacctccactctctcttgcttctcttgtgcttgctttgcctcagcagctgcagtctgtagtggttccacctttctctcccaaatcatctctaccccttggcctaccacttccccgtctcagtcctcagctgcaacttggcagaggtttggggcccacacacctgtgctgctgatactggcctccaaagccgttgacacctgctgtgtcctttttgtctgcctttctcatactgccacccagctcaggtgataaaacaggattggggcagctggagagactgaatcacctgattcccaccctcttcacagtgtccaagaaaatgccagcttctctgccttgaatgttatcctgagggcacaagactagcttatagaggacacttgaggtcaccttggcccttccagtgacttaaatggtggcacagtcttgctcaccatctctctccagcagggtgatgctctccagttcttctcctcctgttccaccctcctcagaaggttgctttctgaatgcagagaacaggagacagaggatgcaggttcttcctttctctctctggtaattcagggaatcagatgactgtgatatgggggctcctgggggaacactgccgccggcttatgccttctgccccagagggcagacggttgctgggatgtttgtgaggagttggaggcatgagaatcctttccctcctgcagcttgctgcgtccatcagtatttacgaagttgctgcctactatggtcaagacatttctgcttcatttgggcagggaagtaaaggacacagccctactctaccatcttttcctctacttttaaggaggttcgaactgtaaaggtgccagggtcatggctgggaacatcagtgttcttaggaaactggaatgttgtggcaccatgggagcagacacaactggaaaagaaacagcagccaagtgataggaaattttcctccagaagtcatcctgtgaccgatatattcacttcagaaatattcgcctcaggatggaacatactcatgccacacaggcagaacacttctgctacctaattcattcatttattcatctcacaaatagttattgattgcctctgctgtgcccggcactcttctgtgtcctgggggtgcagaaatgaacaaagcagaaaaaactcccctgctcttgtggaacttaaattctagcacagagaaaaaaaaagtatcaaacactcatcacaaacaggctgagatttctttcataacgttttattcctatagattgcaacatcccccaaggaggccctcgctcctggttcacttctggatgccttgacatatggaagctccttaactatcttccacgagatgttatcctgacaaaacaaataagaaagcaaacaaacacactgaactggaggtcaggagatcttaacttttagctagttctgctgttcgactgtgggtaatttaactcagttctcctagcatacaatactgtgtgttgacaagaaaatgtttaacagccttcctaactttaaagtactatgattctcatctgaggcatcattctccttgctttgaattgtttcttccatactaacacttgaattttttcttgagtagacagtttccttattgagccgtgtctgtgctgcttaccagcattttggtagtgccttctgtgtgcctagcacacaaccataatagctaatatttatcacgggattaccctgtagcaggcactgtgtgaagtcctttacaggaattcttttaattcattctcacaatacctgtcaggtaggtcttctttctatctccatgtcacacataagggcttagacaatttaagtaatttttcaaggtcgatcacagaaccagtaagagatagagtcaaggctcaaactcagttctggctgactccagagcctaggatcttatatccactataccaccaaaaagtgtgtgtttagtaaatatttattggatggatggatggatggatgaattcagggttgacacttagccagtgttcactggtgtggccgtagcattggtttatggctggaatctattctaattgctgttctgtctgttctatctgttgttgaatggcttgcatatcacccttcgaaggatggatgggtccccacgtagacagctataaaatatagaactgcagcacattcccggaaacctttccatttcatcagtagttagactatggattcagattatggtaatgattttgcctgaatgcctactctatggcagtctaactttatatacctctccttggtagtctgcatgagacctattgtgacaccattggttctgacatctgtattgaatcctctggaagtggaggttcccaggctcttgctgtttgccctcagctgggactttccaaatgaggctgagcttctgtcctcccgctcccgtttcagggttctgctgcttgtcatcctgtttgagaggagcatatagcccctacgatgactgaagctgtgccacacacttaaagatgcatcccagctgagtttccaaacctaaaagaaaataaatattctaaccagggaattgggttattgctgttttaatctgggattccagacaattcccagtggaatgctcatggaaagtacggggaagaatctcaaagccaagacaacagcgggacatttatggtattgctaagtccaaggcacttgtagctgcttattttaaagagatactcatcagattggtatgcctcaaagtgggttcttttcaccattttccattgattaccagataaatcctctcccttaattcttcctttctcttctttcattcttaaatcaacttatattcttgtggatgggggtaaagaggagcagagatcatattatttaaggttctcatacagagagtttctcaccattttattctgcaaacacagagctatacccaaactgaagacacagcatgacaaattagcaagttattgagaagtagagagtgatgccttttccttttatttgccagtgataaaagcaaagtgataaatggagtaaagtgttaagtgctgattagagaggacttgaaaaggactggcaaagaagcctgggcagagtgcaagaggagagcccagggaagaaaggccagaccgtgccatcctgctctgactcactgcccagattaccaggacagtgcccttcaacagtcctacagcagaacccctctgcttaccgggagagcaaacacaagtatgtttgttgagaggatagaaagggcatcattttttcttcttcttcctcttcttccataaagggtactgaattttttttgaagcttgagggtagaagagccgaagtacaattacagtagacaggtgggaaaaaaaaagttgcattctttaaaggaacataagcttttcattgtagcttgaaaacacttgaaagaccaaggacccccaagggtgcccaggcaaggtcactcttgactctacgcagagaagggctgttgctgggagcaaaggatacctttgcccagttctcaccaggggacttgtagtctcgcaagggagggatgttttctgatttgtctacccaaaggccgccctttttctaaactcatgggggagtggctgctgaagggggcagttacagcacctcacgaggtgctgccagcctgctcattggcagaggcttaccttatgaaacactgggcctcagacagtgatgctcaggccccgccttaggataacaatataagtatagttcagattgatggggcagaatttaaataattaaatgtcgttattttaaatttcttttaaacatgatcatttcacatttagttgacattgcgccatttgcccgcagactgtgcattttgcagtgtccatttggccttctaaaatccctgtgaattatatttaaaaatcggaacgtaggactcattcatcatatttaatagggttagggtttatgatgttgcaggttaataaatagccataatagccgctcggcgttttctggagtcagaacaccagaaatagtcccttggctctctttcctttccttgtgaatctttcaaaattcttacattactactcctgcttgtgtgtgtttaataatttaatttaatgccttcctttggaaacattacctcgctgctcacccactcggctgttttgccttctcagcagagtaactgagtttaagacagccacgtgacaggcacagctatattagaaccagcatagtgagaagggatgcagtgcctctcttttctaattgggtagagcaacaattttatatgctttcacattatgtttgttcccaaaaaaaaagaggcaaaattgggagctgaacgtgatcatcattattattttatatttttatacataacaagatgcgctcatacttattgtctcacttaattgtacagcagtccttgaagcaggtgctattgattctgtttgatgagctgaccgtgtctccgataggtcaactggattgtccaggttcacacagcatgtgaaaggccgaatgtgatttctacttcttgaaaccacctttcagcttttttaggagaaaacataatgacataaagagtttcatggacttgaaagtagaggcactgctgaccgctgaagtctgggcagccacaggtgcagggactgggaccggtgtggttctagtgatgccacctgatcatgaagttgtgctgaatcctcagcagactggcttctccctcgtagtaggatgagggagaggaatcaggataacagcctgtccctgtggatggtttattctggttttgttcaccagtcctgctgcctccccgtttgttctcttgcgagctcaggttagagttgaatttctccctacaaccagaatgccagggctggtcctgtaggccctgatgggccagctctgagagtgggctcaatccagtacccaattccccagcattttgctaggggtgcccttctaggagcagggtctcactgcttttggaagtctccaaataaaaaaccatggtaatagaaagggcttgggtctggatagacgtgaatggacttgaatttcagggttggctctattagagagatgatttaacctctctaagactcaagtttctaacgacacctactaatgagggcttcttagaagtatcagagctcatttatgtatagcacctggcatagtgcctggcctgcagtggccaggtagctcaccaaagctccatttctgtttccggttatggtgaatagcctgttgaggaggtggcttccccatgcaggagccaagggaagcagacatgtcgttgtctgtgtgtttcattaaagaaaggacctagggttctgtctgtgtattattgagactaatcttcctaagtcacaatggaaataagctttgctttcaaacgatcccctgtgatttccaggggctcagttttgctctagggcactccatcccaggaccttttcctacccacatgtctctccctcagtctggaactttcttcccgttctcgcctgaatctgtgaatctccttcagccttccccactcttctaatacctatcaagtcctcccctgtcctttgctatcacatcagtgttccaaaaatggcctctcctcacagctgcctgtgacgtgcagtgatatcaccagcagagttgagacaaggacaaggagaagagatttaattctctgtcagtgtcttacaaagcagtaatgacttctaacaaagccgaccagccactagcattttctactttgttcccccttaagccttcttttgggtgccttcactttttacatccaaatgcttgaagctttctactttccccgcggcacatgtggctgtacgagggccctggttagctgcttcaaacagcttgaagagcaaaaacagcccacagcagaacagccaggatgctttggaagggaaatttcctttttgggtttgctgtctgaaagaatttccgatgcaggcagacgttaattcctagctccatgcttcctgataaggaagcagcttcaataaatgcagctatttatagatgtctttttttttttaagaaaaaaaatatataaccagaggtttactgaccttttctttcacttcacatttcatgcagtgagctctgtgtacatttaaggcagttcctccagcgtcagctctgacaaagtggccctggtttcgctgtgggggatggggaggggaggatgaagatggcacggcccctcattagtgtcacgggctctccctttcctcagagttctgaagtagacatttggaaactgttgacaatgggttgtccctacctggtgctctgtgttatttatgtgagcccagaggtgcccagctttattctagactcaacactgaaaggttatagcagactaagagaaccctttaaaaaataaaagacgatgagaaccagtccattttatgaaacttgaacagcaacaggaaatcagaaactttatttccatttcttcttttcttctgtccgttgcttcctcttggattttcccaaccctcaatacgtctgtggtctttctctcgtcttgatgggtttccgcagattgaggagttcctgtccatgagctccacagtcacccttacatgtatctacctaatgctttctggcaggtgtgataaaggttcagtgtgttggcttgaatgtgcttctctaagttacttctcacctcctctgattatcagaaagcattggttgagctgagtatatacaaatacagcagtttccatgctcaaataactgatattttctcccattttgcttcatgtgtgagttacaccacattagtaattcaaacttttggggtttctggcaggatgaccttgacaacttcatcagaggtaaacgttagcagcgacgtttagatgttgctgcttttgctgttgccatgggtggattctgattctcagttgcctgtaccatgtgtgagtgttttgtggttcatttttctgatctcttctgaaggaggggtagagcaggacttgagagatttaaactggccctggctctggccacatgctgactgtaaattcccaagtataattagtcacactgccccaatatttactgcctccatcttgggtgtgtggacaaaaccccattctttcaacattggtctccatttctgcttccagcagatcatggataccagtagctctcaaatggggctgtaagattccagtaatagaaatgcagatgatgggtacggataatggataaagaactgtagatgtggggtggatgacgattggatacctagaagggaaagttgactgcacagggctacgcagtgaataccctattttaccaggtcagctgaggctaaattctctacttctggggtgggggtactaactgaaatggttcactgaggagggtgaaggtttgtaagggaagatgtaacaatacttttttaaaagcacctaggacaagttttagggtgttgaatagcaccatttaaaaattataggggtatccagcaatttatggagctctgattgagaagtatcattgttaggattttattacccatttgttttccagaagtagctcatctttgcaaatgagctttagttttttggtcattgtaccctacctgccagctcacaggagcctgtgtttctccttaggagccactctgaggtcaaccgtgtttaagatcataaagccactctagagaatctctgtggcattgttgtgtggaagaagaaataatgatcactactattattatatatatgtgtgtgtgtgtgtgtgtgtgtgtgtgtgtatataaaagtatatgtgtgtgtgtgtatatatgtatatatgtgtgtatatgtatatgcttcatatatattatcctgaataataacaaactctgcacagtagatattatacctgaggctcaggtaaaccacttgcccgaggtcacccagagaaagtggaggagccccaatttgaatccgtatctaattccaaaacccagacttttattttccacttcaccctattactctttaaaagtctgaggagcaaatgaaagttgtttcattctatctattggttagaaggagaatatccaagctaacaggctgatttttttttccaatttttaagcataatataaattactgacaagagggcccagatggataaaatcagagctataaaccaaattatcttttgaacttgaaggaagataaatttccatatccaatcctgtatgcacactgttatctgccagatagtctcaggtatgtgtgtaaattctggagtgttagaaacaaaactaaatgaagtaaaaagaggttccttgtctattattttccatcttttttaaagagatgatctacctcacagatggttattaaacagtaagaaagatgctgtgattgaatgaagattgtgttactgagtttacaccttaaaacactgaacttcctgataatttgtgttaagccaacacgcttcagaaaaattgcctgacgtttggtgccttagtttacccacatggcatgtgtgccagaacacgctacaacagggtaagagggcagagaacatgctcttgtaggggtcagttccttgagctctggttctacgtggctgattacttgggtcatcccagcagttcattccatctctcaggactgtggtttccacatctgcaaagtgaaatggcctgagtatatgattcctaagttctccccaactcaatcgtcgcattgttctcttattccagaagagaaacacaaggggtatcagcagtggaacattatctgtaaatgccagatttcatgatcattcacttgatttttaggactcaacatcaaattttagtgcagatggtggtactttcatgacacaggaaattgtccttcgttttacctgtgattgttttgggaggaagccctcctgcaaggaaatagggaaatccaacacccagctctgttgagcatttccctatggttcctgtgattgaaatcgggttaatgcttttgtgggatgagaactggtgccagctcctaggccttgcagggcttctaaagactgtccctgccactcttgccttatgctggttcccaggaccttacagccagatcacaggcctgctcccctgttctcatagccccctttctggcctgagaattgtctgtggcttggccctttgccccatgcaacatgcacaggtgtggcttctgctaactatctacttgaccccaactgtgtgattagcggcaatcccctctgcaactcaaggcgtgtttgcctttcctgtaacctgtaaaaaatttcagtctgcgtttttctccctctggagatggtatccactgggttttaggctttacagagccagctgatctgcgtggatgggccacactatcctcccttagccggctccgtagcacatgcacaattaatactgcattaattaattatgggagaaaaaaagcacagttggcaagggaatgaaggctttcagcttctaaagtgaaggctttgatgctgagcttgaaagtacatttccatccgcctcagccagcagagagaatctgtgacacttataccatcccctgggcatgaaaactcacacccaaggaaagtatttctaaatagaggccctcaactagttgctggaatcatctactcattgccatgggctgtgaaaagggggtgtaagattagggagaaaagactcgcccaaagcagcagtgattcgtgaccaaagctgatgaggggttttattttttctccttaagtagctcttaagtcaccaacatcaggaactctttgtagagaaacaaatatgagtaagtgatttggtgccagccctcttgaggacataaaatgactctttctccttcctcctcctcctcgcatgccttgcttcaggaaggaaccctaaggtggtgcaggttcccaaacctgttattcggatgggttggaaggttcatctctgttaggcatggtttcccactagatatgaacaaagtcggggagaaaatgctttcctttttcattctgattccttcacgccattgttcttgaactcctcagctcccacactgactcctttcacttctcctatgaggtggtagtgaagccacctcacaaagtcccctctctgaacagacgcagttctcgttcccctatttacaactctgtcaagcatttttcgtgggggctcttgctgaccttaaaatttggccgtgattcaaatattcatccaggtatctggggttttattaaaggtcttttaggaacacaaaagtaggaattccctgagagaggttttcttcacttgagactcatgggttataaatgaaactactggaatgccctgaccaagtgctgagaggagcttcagagacccacaaaaacctaaaaagatgtgaaatttgtctctgatcaaatagattttggaccttatgaaagaaaataagcttttcttttgattcttagagaaaaatttttgcttcagatgaatccaagtgtgtgtgcacgcacgtgctttcgttgggatcgtcttatagctgttattccagatacctgcttcacaaagcttctgtgattattcctactactgtgacgattcctgccaccccagtgatcggggaaaagaacttgaaatacaactgggtattgtagcattggcactgtgcagacgctgtgtagctctctcatgtctggtacttctttgtttgctaaaggagtattgagattcagaaagtggctgccttctaaacctttattgttcagatagcattactttggacccaggacagagggcttatagttgactgtgaacggggtgaatgttatacttaagcagggaatgtggtcacccagttgcaatgatttagagtgctttgaacataaatatctcccacgatgaatgaccagggtgcctgaaattccattgttgagacattccttttggatcaggcattatttccacatagctccacttttaaaagtaaatcattatggcaggagatagttatggagagagataattaatacctcaagtccctaatatcttaatgaaaattagcttatcagatctcctgaattttttgaagtggaaggaccgtggccagcacggagtgggtagagttggaaataagcactataatttgcttagggctggccttctctgtggataagacagatggaaaactagatggaaaatccaggcctcctgatttagacaaaacattgtgagcctggagctctgaggccaggatgagcagtctgctacttactgtgcgtggccattgctctcaagacattgccatcatcagtcttggccaaagaaggtcaggtctcctctagtacactggcgatttgagaatgtgcaagtcatctgcatttctttgacaggagtagtgaatttgggagtataaatctgaatccttaagcctttcaaccattctcactaaatgtctttacttcagggatgatcacgtttgatcgtaatgccaagatcttgcagatgtataaagggcatggtaatccaagtcttgagttgaagtaagtggtcaggaaaatcttgacccttggggaaggagctaccagagctgggtggcctatgtgtgtgtgacagggaggaggtgtgcagaatttgggggaaagatcctttgtagttctccatgtggaataataacttccatttattgagtgcttatggtaggcgcttttcacatgtattgtatcatttaaccctctaggcagtcctgtgaactgggttttattatcctcatcttactgatgaagagtcaaacttaaagaggaaaaggaacttgaccagagtcacagaggtggtaggtgggagacaggtccatccaatatacaccttgccttccaatagaagccaaagccctattgcctaatctcttcactttaagaacatgaagaatagtgttgagttcccctttgagatctgactgtggttaaagcttcacaaatttcagaaaaacagaataactcactaaaataaaaatttaaagctaccccacagaaaacatctaccacaacccaaaacttcagggtttatatatccagattttagtgaactatatgactctccctagtcccttgctctgtctcctggtaaatactgtccctttcagagccctggcacatacatagtgtaataagatcagaccccatccccctaccattccaatgcaatctaattgcaaagtgaaaatccagggccgtcttagatcctcatctgtctacgtctctcttggtccccactgcttgatacgcagtctcaggttcaataccattctctctttttgtgctttaggtctctgtattgtttccttttcaccacttttttttttttaatgaagtgattttaaatggaaaattaaaaacttaactgtgaatctggcagtttcctgctaatgcctctttgctaagaagcttcataaaatactgtatcttattcacttcagcacagctgctgtgggctctcaccacttaaccattcacaatatgtctgagagattaatttttgtaaggctgtggtttgagatatctcccccttccttgttttacttaaaatcctcagtgggaaagcgtgcatggggaaaaaaaaaaccaccaccaccctggataaaaggtactttggtaacatacgtgctttaggaactataatttgtcattttattttcttgtgccctcttcatttgaaatgctgcagcctttctgccagaagtctcaagtttgtgtatgagactgagggggaaacgagagtaggtaccttgtgctgagactgtcctgggacagtcccgtggtgggtgtgagcgtctgtgtgatgcaggtatgcttatttcttcatgaaagccgcaggtactggttgcctctcgcagggttaaaactcttggcggctcacaggaggtgatgaagagcaagggcacgggagaatgaagaagcaggaggaaggtgtgggccagggtcggtttcggtggggtccccacttgctgggtgaaagctgaactgtttatccacacatcccagcagcagcagaaagccaaggggtgttttcaggactcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccgccattagctgccaccagctccatcttgaacagctctcgagagcagccggcagccaggccgggagcctgtttcttgctcccttgctttgtggctttgcccatccctgacctgcgtggaggccttataggttatgtgacagccctatgctgccaagacacagaaatgacctctttccttccccttttgacataaagcaatgattgaagacgtcttcagcaatggggtgggggcgggcagtcaggggagaatgcagccatttcctcaggccggcctttaaaatcttgaaggcagtaaatgtaagtgctattccggtcttgggagctgggtctgaattctttgctttgttgaaggaaatagggctctgtgctgggtggacgatattcttgtacctgaacatgtcattttcttcagttccatcagcctgcatgtggtgctttgttttgtttctgaaattgacatgatgatgccttaggaactaaatttttttctttaatggaacaggctaggagaaagaaggatggcggtatcatttggggcgtgagaacagtcattattaattaggcttaagttaatgaaataaaaaaggcacaggctttgaaatcagttgtctaaatttaagggccagctctaacaatatacaaccagcaatgtaaccttgaacaagtcactgaacctcccagcctcagtttccttatctctaaaatgggtacagtcatacctttttcacattgttgtgaggaaattagattatgatttcagaggcactttgtgaattcctataagccttcatacttcttattaaaccactattgggatctctggagactgaaatatagtattaggctaagacagcagaattgtagaatttgtagatcaatttggcaaatatttagtagaagtcttctatgtgtgcagcatggctcgactctgtgggggaaaataaacaagtggaaagtttcaggtggccgcatggtatagcagaaagaatattggacttggggccaggaggccagggttcaatcctggctgtcactcagttgcctgtgacttggtatgaactgtttaaccttgatgagcctcagttgctcatctgtaaaactgggagaaatcaaactctatgaccttaataaactctgtccaactctaacattgtataatcagttttaagaggtttttgcctttagcagctgtttataggatttattctaaagagtagggaagaaatattcattgtataagagcttgtctgatgaagaagattgcatgaaaaagctacacttttttaataagtatatctgatgtaaacaggaaaaatgggtgcttgccagatatgtcatctatagcaacttgttttgagggggtctctgaatgctgacatgaaaatgactaggatcatgggttgaacgtgagtttgctcaagagaaggttctcttggggctttggtttacttcctcccagctgctccagggaacactcaggatatttccaaatggctgctcatttaagccattcccgttatggttctccttgtccaaattggcttccatggtacagtcccagtgttgactggttctgctaatttgattctttttttttttaatgtgctgatatgtagttttaggactgctgcattattgttcctctatctttccgtttgtattagtaaagaactattagcaattttgcctcagtcttctaagcacgctttttgattggagaaaaccaaggtaccagaaaacttagataccatgtggaaagtcacagtttactgggtgtgtactatgtgttactagtgctttaataaatttcctcattaattttattctcccagcaagcctggcaggtagctgatagtatctttgctttacacatacagaaactagggcttagagatggtaagtaattgggtcaaggccacagaactggctggtagcagagccagaatttgaactcatgtctgcctgctccaaagcctgtgttctttatcccctcagtgcacccctactgttttgactgctgttaaattgaccttatgcttagaaccgaagtcaaacccgtaccagggctgcaaaaagaaacaaaattaacctcatagtctgcatactctcgaaatggcaaaaaagcctgcaactttccgttgtggaaaataatatacctgggtgataaactgagcaaacatcacccttgcccttgcctctgaaagagagcctgttctagttcatcctggggccagcttggcctggaaccccactggccagctctgtccacaccttgcatattaggacagaaatctgcctaccacattccagctacataaagaaggtggccagcacctgactgcctctttctccttgtgaaattccttggaaataccatttgtgactgcttgggcttgttctgaagaaaattcaaatcttgttctgtttaacaaggattgattgaagaacccgtaggctcagtgctagtacaaagataagcaaggaaggaactcagaataagagagaaaaaacttggataataattatcaaaaccagtatttattgagcacctactgtgcccagtagagtagtaattacaggaggtaaatatctaaaacttacatagctcttcacagaacatacatctgttcttgcttctgtgtttgattttattagctttcctctgtacacataagcttttagtgtatgtcctattattgaagtccagagttttattatttttcacttatttgggcatagatagttccagaatttacttgtcttcctcattctcattgttaatctcatttttcttccctggagaatatggactttcaaaactatttttcaatcaaggccaaaatatttcttaaaattcacttctatttaaaacacagataacatccaggagaaaatctgagaagaaaaaaaaaaacgattttgatggtacctgattataaaagactcacagtactaagttattctttggcacgtgtagcaaaatactatgtaggtgtcatttcgagttcatagtaaggggagaaatggtgtcatttttcctgcagagaaatttaatctttcactttaatctttcattggcctatagcagccagtggggtcttttaaaaaattcttttccttcatattccccgtttgagcttaaggtacaaaaaaagaaaatactcttgaaatgctgtgaccagatctagactgtaacatgccccttcactcctctggtgaggaagtgcgggaaggtggaagacattgaggggttgattatttacttcgtttggaagtaagaagggaggtagctcttatttggaataagagctgtcttcagaacaggtgtgtgctctcctgaagcccagagctgtgactccctgggtgtgtctcttacctgtgcccttgggcaggtggcacgggagaagaatacgataagaggaggatggtacagacagaggagtcacaggctgaacaggctgtcaccggggcaagatgactgacaggtggatggaattcaccatcctttcctttcaatcaaaaaaaaggtagaaagttgctcataagtaagtttgagttatatcatcttcttcatagccgttgctcttcagacacaggtgctggtaatcaggaaaatgcaaggaaacagctctggggaaaaggaacaagcctcgttggccttgagagccccagtagaccatcaggccttgctttggatattgggaggtgacagtgccttctcacgtgcctgacagtttccctgcaccaccaagactctgtgtgactgaggccgtggcccgggtttcaggatgggcattcagaggaaggaagttccccctccttcacttacctcacgcttactagatgctgggttgcctatgcccatgttaaaggaagccagataactttctgtccccatgtgatccaggcccatcctgaagcctgggggttctgaacataagtatggcggttgcagccttccttctgtgacttctggaattcctgacagagagggtcatatctagccactgtcaaccggatgctagacttgttttgttaggcccttcctccttcccttcctctacttatcttccaataaccttaggatttggaggaaattaaaataaaccttcttctagaaaggtgtcagggacccatgcacaaatgtagcctttttgatgcttgagaaagaatgcctttttgacttccgtgaataaagaataagtcacggctaatgagtaagtaacagcacgtgcctgtggtcccagttattcaggagactgaggcaggaggattgcttgatcccatgagttcaaggctgcagtgagccatgattgtgccactgcactccagcctgaacaacagagcaagaccccatctcttaaaaaaaaaaaggaaaaatgcctatgcaatggctctgaggcaccctcatggttgatccaatggccttgcctagtgattttgacatgctttaacttgtgaccaacatctagtctatttgtctcccattagagactggttgtgacagcattgccattgacctgccatatataggaactccagtgtctgaaaacatagcaggactttgtaggtattaacattgagcagtgctttcacattttacagcttaccgtgatgagcaagatattgtgtcaaaaatagtgcattgcagatatcaataagaggtagggtaggcagtgatttcagtggtgtcccactccacactgtaattttgtttctttggtcaactaatgtaagaactgagtctgtaactctaacctagggagccattgctgtgtgtcaactttgttgctttaaaatcttgagacaccttttcagtatctcccactttgtctgagtagtcatacttttaatgatatttaaaagtcaaactctaaatactttggagctaaatctcagcagagataaacttcaaactggtgggagtgggggtagagaaacccttctgggagtcagaatgagatacttgtgtgtctggactggtggcaggtttgtatgttaccagagtgatctccatggtaacggatcaacatggcgccaatgacaactctacactaagagcttcaggttcccatgagaaagtggatcctcacagcaaataggaagaaatcaagaaatatggatccacactccccttccctgtagaattctggccgtgaagtttcagttcatataaccaacaccatgtcctatttaaccacttgggtccctctgagtaaaccaagactcttctgagaatgcagtgttctctcagatttcaactaaattcatacaaagtttaatcagacttgcatagcaaagaactatattgcagtggagcaagaatgtaacttggagtcaggaagcctggcctccagacccagctctgacactgtgatatgaggaaatcacctcgcaggttcttattttccagattctcaaattcccaccagtgctgatggtcaatcatccaattatattgaaagcccttagtatgatacatcagcagtaggaaaggtagatgactaaatataatacagtgtgccttttcctacaccatcaaaggtatgataatgttgtgatcatgtgtataaaaactttcagacacctaaaaagtagaaggtgtgattcatctctgttaaagcttaatctctgagcataacaaccaacatctggaagctaggcagccaacagaggggttaatttttctggaaccttggttgcaaaaggttattagtttgcagaaagactcagagatcactgtttatcttaaaccacaagagaatgtttttgaattcagaagaacagtgatatagttcggtaatttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaagaatggtaatgctccatttaaactttccttgtgattctctctggtctaccttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgccgtgagccgagattgcaccactacattccagcttagtgacagagtgagactccatctcaaaaaaaaaaaaaaaaaaaatgaaatcttgatcttattgccttgtcacctttttgtcttaagtttactttgttggtataaagaattttttttaattcagcaagagctcaaagagccatatatatatatataaatttttttttaattaaaaatctttctgctcaagtctcaactacagtgagactgaatggaaaatgcaaaagctcttgacatgatgtcggaatgaacaagatggagaggttgaatttgagaacatggtttccttattgtgaaattccagtttcagaacattggcactgtctggttcaaatataaatacacattattttattgtaatccgctagtttaaattgtttattctgcttataaggaagagatccatgatagctgtgaacccctttgaaggagactttatccatggctcagtccaaggtgtttgaagcacttttctcatggcctggctggaaagactttcagaaataagcagggttctggtaggaaaatgaaggcagttgaggaaaacagtgcacatatttgtaagaggactatacttggtatcttggaaaacataaacagaccctagactgtctaccccaagtctgggaaggcggtcctctgaagctgaggttctcctggaactcccttccacagggctgcgttgcaaatgccattgtggaggcatcacccgatgtggtggacctgaacattggggaaatgcagtgctgcctgctgctgcgctggctggcatctgccctcctccgtctcctgggtgctgccacagagaagagagagagagtgaagcgggcagagactggctgttgccatcacacaactgagggcggacctggagctcagccggctgagggtttgagagaccgttgggagcaagacccaaccacaaggcccatggaagaggaagttggcagatctcagaaaggggaggaaaaggagaggtgcttatttgttcatcttgtttttgcttttaaggaaaggaggagagttaaatgagaaaggagggcgagttgagaaggttctgagcagtttcaggtccacggttgagcaatgttcttcctggtcaacaaactgcctggatttcattttggcctgacaacagccccaccacctagggaactgcacagagatcctgtgtgttaaccacgcaagagagtctgcagttagaatactggggcttgtgcagagagaagaattcagaaagtcaaaggctggatgtaggtgaagagactatggactctgccttcatgtcatcagttaaagtgccctgcacacctgcctgtcctaggtcctgtagggatgtgatataacaagcatgagctataccttagtgtctgtgttccagaactttgttggctcccgaagcacctttccctcctcccaagaggaataaacaaatgtaaataaatggtgcccaggttttcatttggctcacaaaagattatataaaactcatagtctgtctgaagtatgttacctgtaaacctgtttcagctaaccaccttttctagcacaatcaagctggtaaaatacatgcctgcacgccagccacggtactgaggaccacatcaaaactgctccttgaaggaacttggagaaaatgaacaaccagcaacttgttagctggtctctgaatgacagagggtactgctttagatgtcccccaggaattctgagtttatgcagcagagggaccgtagccccggggtcaggcaggacaaggggatcagaccttcctcttgctatgtgtggatcattattcagctgaatgtctctaatcaggaactctgggcataaaaacacgatctctgcagacttgtgtgtggctagacgccctctgtgtgctgtatttgtaattctctgtctctgtatggtttcagccttggaagaagctttgaaccagtgatgagtttgctttccgcagtcaaaactgtggtttgagaatttcactgttaataattgggagtaaaggaaaaagctgggctattgaagggtaaagccgatgtccctaggactgtggcctcaggaagatgactggatggcggcagcagaactgatggcagaaaccagggaagctgatgttgtattgcagcctccctcacacagattctaatcctagaaagtggactgtggaaaaaaacttaactattcacaacaaacgtttaccagtcttatttagtggcaggccttgtgatgagtgctggggttaaaccataagtcaaatacagacactgctgtctttattattcattaaaatgtctttagggtaattttgtatttacatcttcagcaaatattaactgagcacctgtgatcaaccacatagctgctaggcactgtgaataccgtggtagacaagaacagacgcttttcttgttaatccgtggaatttacaatctagaggggagactccacctaccccaccagatgtgtgcagaaggcgccatcactgctttagtttcaggtctttgctcaggtcattgctcacactgagtccacatttataagttttcctgtcgggtgagctgccgaagggccagggaacgtgataaaccatacaagcagcgcatccaagaagtggtttctgagcagtcactgagacagcgagggttccctgcactgagcaccaagttattactattttccatacacgtcaatatgttattgattgcttcactgtgctgatctgtttttgtttcatgtggctctttgggtctgtctaacctggtattttcagtctcaccagcatttctaaagttctagagacccatttcatccaccttacaccatgtctaccacagtgccaggcatcaagcctgctaattgtgcttgatggtgattattaccagccccggatttgtaagagtcaccagcagtggcatttcaagatttagcctgggagctcacggttatgtggaaagaggggctcaagactaagcccagggaggttttggggtgatagaattgattctttacactgaacgtgaatcctcagtgatgttttgatgaggatgcgggacattgtgctatgctaaagcccgtcacagcagcattaaaaatgtcccagtatggagacctgacttacaccttggctcaatcattaaattaaataactcaccaaagaataaataccaacaaatactagaaatgttgatttttagaataataaaatatcagtttttgttttttgaactggcagggaatttttttttttttctttttgtagagacagtatcatgctatgtttcccaggctggtctccaagtcctggcctcaagctatcctcctgctgtggccgcccaaagtgctgggataaaaggcatgagccaccacacccagccagaattttttaaatgttaattttcaatacacatgtagctatgaggagatggacacattctttctatctgacacacctggtcactccaaacgttcagcacttcacatgggaggctacatatggaagtgaaatgaaaaatcaccagcagccgcagaacaaaaatataatccagtgagcataacttttatggaagcacttcagcaatatgggtaaaggacctgaaaacacttttgctctttggctcactaattccttttctaataacccatccctagggaacactctccgatgctgacaaaccttcttacacatggttctgcagagcagcagaggccaccaccagcaaggttcaataaattaaggcaggtcattatgtgggactattatgcactaattaaaaatcacattttttaggccgggcgcagtggctcacgcctgtaatcccagcactttgggaggccaaggcgggtggatcacaaggtcaggagactgcgaccatcctggctaacacagtgaaaccccgtctctgctaaaaatatttaaaaaattagccaggcgtggtggcaggtgcctgtagtcccagctactcgggaggctgaggcaggagaatggcgtgaacctgggaggcggagcttgcagtgagccgagatagcgccactgcactccagcctgggtgacagagtgagactccgtgtcaaaaaaaaaaaaaaaaaaaaaaatcacgttttttaaatgctcatataatataattgaaaaggcagggtacaaatctctctcttcagagtcatctcaattgtttttaatccataaaaataaaccaaaaggctatggaggaaaatagttattgtggttatctctaggtagaaggattgtgggtagaatttctttctctttactgtggagtttttttgttttttttttcttctggcattgcccaggattatttctgtccatcagggcgtagtgggtcacttctgtacccagcagcttgcacctagatttattgtgtcaaaatgcaaatctgggcgtgcattttccattgtcccctccccacctgcgcttaaaacccctccttgtcttcctgctgtaagtaggataaatgcaccagctgtactgggcctttcccatttcccatgctgatcacattctctcgcctctttcttctggctacaacacacttcttcattccaaacccttccccctgacccacctccaccccccaccctagcaagattaattccctgtaattctagttcatccttttggccccagtttaagccatttattcatgccaggctttacagaagactcaccagcacctccaatgggcttccaaggtgctctcaacttcccttaacacaggttcccagtttatcctcaccactgaagcccaagagctgggactgtgccagattgatcaccagtgcattcccccagcacacagcaggactcggctcaccctggatggttcttaagcatttatgaatgggtggatctcacctacgtgacctggaacttctctgttctcagagcaagccatgtcaaatagcagaaaatgcaccggctttggagcctactgcaggactagatgtctcagggtcgcagtttcctcatccctaaaaaggggaatcacgatgcttatctcatgcagttattgtgaggttacaagagttactgcttatgaagggccctgtccagcatctggcacgtggcaggtcctccgtgaatgacagcgccttcctgggcagcctggcgagcgcacacgcgtgtgcacacacacacactcctgtgtttaatatagccctgtctgttgtgagccacttgaggagaggtgtccctagaagaaacttttttcccagaaaatgaggcctggctggtgctcatcctgagttcctggaaggcagtgttttcttgtaaccatctgagattcctggggctgggtatagtgcctgatgctctcaatatatgcgtgttgaatcaaaccagaagaagcaggctgaggcactgagtgaaaacctatgtggatgtcctgctgccttttccttgtggagggtagatcattcccaactctgcctgaaactttgatgccttattggaggaagagaaaggtaactcccttgttgagccatagagctcttagtttttctttcttaaaaaaaaaatcactcttctttcaaacaccattaaattagtccagttatgtacactgggcttgtattgcatggtttatataaaagctaagttctttctttaagattggagccctccgtgtgagtgatttcaggataaaaggccttagaggattagacacattattcgtttgtaaaactgattgctcaagtgatacagccctagggctgcccccttattgtagcttcttgaacactgtcaaactgtcagacttgggttggtggttattttatctcgcaaacaaccaaaaccagatttacattgtaagtagatactagcgtggcttttgtccttcctatatctaggccctgaatacttcagagccagattaaatgctttgctctattttttcatagatttgggcttcgaccaaacatacaagttgagcctgttgacttctctctttgtggatgcacacgtgcgtctctgcgtatatttgtgcatgctttcccgaataagtcctcttttaaaactcagcctttcatcattttagaaatgatttgctcttttacagcttgtactttttatggttcttagaggatcactgcagcaaatatatttggcagaaattgagcacacaagcccttccccagaactcagtactgaatttgttcagttcccatcttaaaaacttgaaactcctttgacttttcctgtgatgtgcttatttctgatctgaaactgtagttcaaagctagacttggtaatcattcacgtcaagaaaggaatggattgctcaaaaaagaagtcagactctaaaaatagcctccataccgaggcccacttttctacctagggaatcaagacagaaatatttccaggattgaaatgacatagttcaagtgacgcaaccatttggctgcctgctatttttctcttttctgccagaaggaaaatatataatgtagaaaaattcccctagagttgttaaaataatcactgaaataacctttggtgcttagtatggtaccctggaaaacttggatctctagaatggttcatttcagagcttttccagatagccaagtttttattagaaaattggttggtatagacggtgctcactgtgactgttcagtgcatgatgagaatccttctttacagagataaaaagtgtgaagagaattgctgagaagtaaccattcattcccttctgcatttgcctagtgtgctgtgtaattaaatgagctgataaaatttacaagaaataaagctttatgcaattacaaatagatgacatgactttttaaaaggttttgcccatatttttcacacacgctctacctttagccttctctgctttcacacagatgctgaaaaacaaaagagttaattagaaaccattccttttctctctttctggtacagagaaggcttccactaagtatgtgctgaataaatgacccagtctgaaagttttaatttattacacagtatattcatagaactgtaactgttacaacctctagtttgatagatgtagctgtttttgtttttttaagttgagattatattaatatctgtcacttgggttgccagccttttagaagaaaatttggggtttatattagaataggttttaggttcagtagcctgtatccttttttactgccctgggacaacagcaaatattcacctaaattcattctgtggtgtaacactttagaagtataccagttcttccttgcaaataacaacaaaaagctctgaacaacttaatcacagagaaaaaaaaagcttttattggaggtatattgggcagctcattggctgataaggtagcagaagcaaaaggatacttggcagcccggagcttagctgagatggagccataaggacagttttattaggatgccaccacagctcggctgccagtggacacatgaattcgtgagactagcacctctgccataaataacatctcaccatccctggggaattggtcactcccttaagactcaaacactgtggcaagtgcatctaattggctgagtccaggttatgttccagggaacaggggagaaagctctgccaatcttgggattcccccacatgcggtatgtggatgctgagcagacaaaaatatagaagtctagtagatgattgtaagttactgtatagcagtgtgtttcatcttgttcttacgtcctgtggaagctttcttcatggcgaagttaagcagttccacatctgcattcccccagatcagcacaccaaaggtgaacagcttgggtttccccctactttcagttacaggtacaagatgttagcaaactatgcaaatctcaatgagttttgtttcctaattctgtttgcatgctaggaaacttgcctcatgatacaacagtaaacccctgctttaagaaaaacatgaggctggtttaatatgtacaatgtccaactcttaggaagtgtttatttttcaattgcctttaataatttctcataaagatcgatgagtctaagaattgtgaaggacctcagagatgatatatttcaacttgtcatccacgtcacgactgtctctttagcatcccagagatagcaggacagtcctcccctgcttgtgtgtattcagtgggaagtacttccctgcccccttttcgtcccgttcttggatggtgctagatgtgaaaaatagagttgaaactcacctcactgtcactttgctcttggttctagttttgccatgtgaaaccagatagggtgtattctttctacattaagtctagagacagaactttggaatcagatatggatttgatgctcagctttgccatttacccaaaatgaaacagttactttaacagtatttttcgtctaatatgtgcaaactaattgctgaatggataggcagttattttattaatgcaacaaaaggttatgttagcattttaatatttgtgttgtattcacattgatcgtttttacttggactatagccaaagtcagaactcttcttttgtggattttttaaacttaaaatatatgcctttacatttaaccctattacgttttatttaagttggctgaggtaatgcctatcatcccttctataaactcctctttcctactttatggcttctatattagatgagtactttctctgtacctttatgttaattatttggaagggaaaaagattgaatgggacgggacctgtgaaagatccctgtggcataccgctagagactgccttccaggtaggcatagttttaaaactataaagttaactttatagttaacaagtatattgtgattatgttttctggcaaataaatctctttgctgccatatgccataaatgacacattatcatttttgcaaatatgcacaatggtactacatatcaattgactgtcagcctaacccataagaaaaagtcaggatagactgtcaagttatttgctgaaatcagatgcactgcttggctctctgtaaaatctttaccaagtaccctctttcactttactcgtctactcatggcaaatctaaaaccttctacttcagcttaggcaagacatcttcttgggtcagtggtagatgtgaacaatcttcgtgggtcagtggtagtttaacagtttgttaaactgttgttaatcaatgtatctactctcggtgattttaagagagaaaagaagactttttgtttttgtctgagaggagtttttaacctggaaagacagctgaaacgttatctgaaatgtgaaatgttaaacattttattattaagagacagtgtgttttttattttactcacacagtatgtgtgcatttgtgttttctgcgactgcacatttgtaataataggctcatattttgtttttcattttaaaattggctttgtaggatgttcactaatgtggaaagacagagggattggggaatcactgggaaatgcttggagtcagtctgttatgtagatgtgcaaggtattgactacagagtgagacactcttgcttggttatgtcctatttctctctgaattttttaattctcaaaaagtaatttagaactataacaccttggtttgtatgagtgtaaaatgatttataagataacctcaggtgtgttgacagaagaaatgcaattaaattgtttccatgtttaagaaaaatatgggaggtatatgtattataagtatacatctattgactggctaaagaagaaaagatgactagggtatgccatgctaaggagtttagattttgtgctggaagtttaaataggggagagaagggatgtgtgttcagaaggcttttgtaggtagcagctgtagcaatgatctaggtgagaaaaaaataagtacaagccaaagcagtgtcagagagatggagtgaaagagaaacattcaagtgattaagcagattgattgggcaaggtgagtggcagatcagatgaggagcaagggatgggaagcagaaaagacaagtctccgtggagcccattatctagagtggcaagacgagaaggaagagcctataagagggctccccagagagacaggagggaaatcacagagatcaaggaaggagaatttcaggaaggaaagaatgatcctgcccaatcagatgctgcatagaattcaggtaagatgaggactgaaggtgtctttggcttttccaagtagggaagtcatcagtgacccagtaagcacaatttctgtggcggggagaggcaggtggaaacctgattgctgtgggttgaaatgtggaagaaagtgattatagatgactctcttactggattggaatcgagagaaaagataggatctggaaggcaacagcgggtgaagggaggtttttgcttttgttttgtttatttaatggacggtatttagccatgtagaattgttggtaagaatcagagagttgaaaataaaggagaaatatggggtgatttatggaacagagtccttgtagaagtgagaaaaaataagaggcaaagtaaaaatggaggtattatttcattttcaatggaaagatggacacttgttacactgaaatcagaggaaaggtgtgtgtgaacataagacagttgtttgtatgggggcaggcttcataacttgtggaaactcccacttcacagcctttttgtttgtggttggttgtttttttgtttgtttgtttgtttgttttgcctgagaagccaaagatacaggaggtggcagtgaaggaaatgggagagtgcctgattgagccaagctggggtccccccaccgcgtggcatcgcctcccagtgggaggcctggagtttgtattgatactaatttgtctgtctgtgtggtttccccctgtgctgctcaacaccgtagtgtaggaggggtgaaaggagatggtgagacccattctttcaggaaatattaactgagcacctgctatgtgccaagtgtgttctaaactatcaagatacaggccaggcacagtggctcatgcctgtaatcccagcactttgggaggccaaggtgggcggatcacttgagatcaggagttcgagaccagcctggccaacatgttgaaaccccgtcttcactaaaaatacaaaattagctgggcgtggtggcacccgcctgtaatccactactcaggaggctaaggcaggagaatcacttgaacctgggaggctgaggtgggaagattgcttgaaccctggaggcggaggttgcagtgagccgagatcacgccactgcactcgcgcctgggtgacacagcgagactccatctcaaaaaaaaaaaaaaaaagatacagaatttaacacaggaggagcaagccatgtgactatgtgagttcaaagtattccaagcacaaacaacaataaagaccttgaggagggaaagtgtttgatgtattaaaaggaacgcgaggaagcaaatgtgtctaaagtgattggcaagtgaggaagagcggagttcggaaacaggagtggggcaagaggacttgggaggaggctgtaggccactgtaaagatactgtgttttttgtcattttctgagacaggctcttgcctcggctggagtgcagtggtgtaatcatagctcactgcagccgcaaactcttgggctcatgatccttccgccgcagcctccagagtagctggaactacaagtgtgcaccccgtgccttgctaattttttttttttttttttttttttggtagaaatgaggtctcactatgttacccaggctggtctcaaactcccagcctcaagcaatcctcctaccgcagcctcccaaaatgctaggattacaggcatgaaccactgcgcctggccgggactttggcttgtattaataatttgccaatgagaattgtaagcaatggattgacatgctctttgaattttaaggaatcattctagctattgtgtagaggataggaagagggagagtgggagaaaggagggggaagtgtgaaagtagagaggcctgttagggatctcttaataagtctggcaagacatgatggcaggccgtaccaagcatgttcctacctcaggcctttgcacttgctgacctcgctcgctgggatgctcttctaccaaatatatacttgaaccactgcgtccctccttcagagatatctgctgaaatgtgaggtcttcatagtaaacctcaccccttcacttgtataccctttccatgacattttttcctctataacatttatcaccatttgacacagtgtatattttacttgtttatttacttagtgcctgatttcctgactaggatgtaagctcaagaacagggatttttctgtttcgttcattgctgtgtccctgatgcctagaacaatgcctgcagtgaggaggtactcaataagtatttgttgaatcaattagggaatgaagctcttccatctccattatcaccaataccacctctacagttataattagtgagaattatggcagtgctaatgttattttttcatttccatgtgtgcctttttggaaagacttgctgcaacaagcttcacatatcttcctctgcagagtagaagtatgtcactaagccatggagttgatttcttggctccttgtatagcaaatagccttgcatttggttcgtgtcagtctttgcatctttttttagtcacgttgcctacacccttcacaatcctctagcttaaactcttgagtaactctggacactggcgttagctggaaacttgagaaccagaggaatgatactgccaataacatgccttatgtgcttggcatctaattttggcacttgttttagcaggtttgattgcataatttagccattggctacaaaaaaaaatggccacatatcctgggaggaagggaagatttggaggtataagatggaatctgtcctagggatttgaggacgggctacggttcttgttttttttaaaatattccttcattttcaatactcttgggattattccaggccttatgcattgaccatcactcaatattacttcctttggggagtatggtatgacgccatcatttctggtcttttcatatgaagtctccatttttattatatttttcatgcctgaatctcaggttttgcaatattttctctaccacaaaatctgttatcaattaagtacaacttaatttgttttttttttcacttttccctaattaaagatatatatacgctaattcagaataagtatgaaatataataactggaaataggacatataattgacataatcccaaaataaaaacaaataatttgtagatttagtcctcatagtctcactggatcaatataggatttctgatcaaatatgatgcattttgagaaccctcagtttatgtctagaggagagtcttttatttttaatgtgcgggatttaagttgtaagtgaagaggactgcgtcaagaggcaggatagtagttctaccccaaaacagatgtgtgatgttgaacgagtcacttggagaaggatgccatggagagtattgggccaggtgatttctaaagactcttccagcattaaaatacattaattctttgcatacatccatgccttttgctgcttttgcagctttcagggttaatgagagctgtcaggagcagtatgaccttagagggaaatggctcatatcaagagagcagatgccaatcccttctagtactctccctgggcagatgacccactccctatttaaatccttggctttttttcttctctgataagtgcctgcataattgatactgttgccagtgatcaaacgctgaaatgactaaatgatagagctgaaaaagaccctaaggtgttatctagtccaattatgccccctaaaccccaaagagtctgaaagagtaatggggcccatgagccaagtttagtatttcaaatgtctcgtggtaattctatatttggagacaatattgtaaggttaagcaagctgtggaagcatgaggttgctctgcttatggctggagttataaatgtgaaaatggatcagttattcctagtaactgctcttgagtaagcagaatctttcaaaatgtcatagctttgttgtctaatacataatggccactcaccacatacggctttcaagcacttgaatgtgactgatccttactgagttacgctgtgagtgtaaaccacacatcagatttcaaaaacttagtataaaaaagtgaatatttcattaatttatattgattatctgtttaaatgatattttcaatacattgggttatataaaatattttattaaaagtgatgtcgattgtgtgtttttacttctctttactgtggggactaaaatattttaaattccattatatgggtaacatttctattgggagtactgctctagagtaagagatttctgggtgtgaaaaggctgagactcactccttgttttgcaggtgagtaaggtgggtcagagaggttaggccatttgttcaagatcacacagcaagtaggtagccaagttaggagtaggccagcatactttcctttaccaaaaatggccaaagggatcatagtgatttttttacatggagtctatgacattgctgctttgggtcaaagccaaaaatattgtgtagaatattagcagttttctaaagccctaagcccaagttgtatcacccagtatcaaatccaatcaaaaatatattaaaaagaatacaaggaagaaaaggaaagaggagaaacctccctatagaagacccagtaagcaatctgttttcattcttgaacagatttctttcacaccagtgccctggtattactggaaaaaagtacattaattacgggagtaaagcacaataagaaaacatttacaaggagtccagccctcatccatcatgcctttccctccaacaaagcaagaatctctttaacaaatacccattaaaagattaagcctaagaataaattgtttcttagtccccaggcagttcatttgacatcatttccataggattagggactccagcaatatgtgtttagcacagggctatagtcacactgcatagtattggtctaaaccattccaaaatatttttttagatctcgaactaataagacttttatgtggctggtaattatactaatatttcacccacaaattgggcctttttccccctccacagtgtgtaaccaaacgcagcaattctgcctttaaaaaaaacgaaccaccacctgttaaaaagtggtctaggaagtatagcaatgtcatggagctcttgaggatgtgtataattgaatagaaaggaaacctagcatctggcgcactcagttcttagtcccttttcctctgagccatcatttctcttctgataactgtatttggttcttataattactgatactatgatgtgtggagtttaaagtacccaacagttgtataaggcttgttacaaacaccttcaatgtccccactcccctcccttcactcttgatttctttttgatttcctgctcaccagggcaaccacattcaaatcttttaactgattcttttgtcattcacctcctccaattcttaaatcacgtgcttgtattggtttttttttttttttttcatttctaaatattatctagcattatttcactgtaggaaatgacagtttgtcctttcttccccctaccccaacccctcccatagatgcatcctcgtaatcataattttggacagaacaatttagtgtttacatattaagattatataagtgccatttgaagctgagtcacctactcttttatggttcttcttttccagtcacttttctttttccctggagttgataatgatgcttttatagtatatttattgtttttgttgttgttgttgctgttttgagacagaggctcacattgtcgcccggactggagtgcagttgtgtgatctctgctcactgcaacctctgcctctcaggttcaagcgattgtcctgcctcagcctcccgagtagctgggattacaggcgccagccaccatgcccagctaatttcttgtatttttagtagagacgggttttcaccatgttggccaggctagtctcaaactcctgacctcacgattcgcccgcctcagcctcccaaagtgctgggattacaggggtgagccacgatcgtatttcttgttttaatgtccttcttacttggttttttatctccttcactaattcatccgccctgcctcactctcctctcagtagttcagatgccataggtgtgatgagccttgaagcaagagcttctacctgcttcggtctgggcttcagcttggtgcccagctatgacctttgttcactttttctctccttcgggtgtgagtccctttcctgaattctggccttaatggaggacaatttccaatagcttcctgagaaagggtaggggggaggcaactttattgagaccttgcgtgtctgaagaatgtctttcttctttcctcatacttgatagattatttcctcatacttgatagattatttgtcttactgtatgattttagacatggggtaattttcccccagaattttgaaggtagcactccattgcattttttttcagtgccattgttgagaagaccatgccattccgatctttaatcttttgcataaacctttgtttgttgacttattgttccctggaagcatttttttattccccagattctgcagttttacagtaatgtgccttagtctgggtctgtgctaatcctgatgctctttcaatctggatattcatttcctttcattctgggaactgtcctcctgttttcttcattctttctccagaactcccattattaggatgtaggtccaataattatctttatttttcacctcttaatattttaagttcctcttggagagattcctcaaccttttttgtcagcacttcttttttttttgtttctgatatcatacttttaatattcaagtactttttttgttcgacttgttcttcattatagcatcttgtttttgtttcatagttgcaatatcttatttctctctggatgatatttttctttccctgagttgtctgttttccccacgttgcctttgtctggttttggtctttgttttgctgtctgccttctatactcaaacgtctggtgatccctgcatgtctgcccatttctgagagttgatggacccctcaagcactgaaggcaagttctccgtgcctgggtgaacgtgctctctagggtggcctgcccacacatttccttgggatgccattgggtaaatatctccaggtcttttgtctttggctgcttagattcccaagagatggttgactcttctagtagccatcctggagggtagattctagctgccaacctcctaggagcacagtgggagaagaaggggtagggggcacagtgagcacagtggtcaacatatgcatgttcttttaatctttcatataatttccgttaattccacctagtcattttggtaccagaggataaacttttttttttttttttttttgagacagagtatctgttgcccatgctggagggcagtaacataatcttggctcactgcaaccttcacctcctggattcaagcgattctcctgcctcagcctccctagtagctgggatcacaggcgcgcgccaccacacccggctaatttttgtatttttagtagagacgggctttcaccatgttggccagcatgtgggtctggaacccctgacctcaagtgatctgcccaccttggcctcccaaagtgctgggattgcagctgtgagccattgcgcccggccagagcttaagcttctaatctgccatggtaggggaggagccgtgactcgactgtccagattttcacatgtaactagtgacaccagtccccaatcctttcacggattctgccatgtgaatttggttatatcacatctttccttactatgagtttagaattccgctttcttgggtttgctaagtaaattaccaccggttcttctgctttcaagtttctggtttgtttttctttctttttctcccctccctccacccccttatctcttctggtgtctttgtccttgtagatttgtgccttcttaaaaatctcttcactgttactttagaggatttgggggaacgagaacagagctaaaattaacttcctcctctgatgaatgttgacagtcttcctgccatagggatgttgtccaaaatacgtgttcatgtgtatgtcaaactagagcttctcaggaggaaagctctttgtccattgaaattgttgtcactattgatagtctttttacccttagaccagtacaacttgagtcacacgtgtggcccataaagattcctgtaaggtcgtgcataagggacaagtagttgtagctttgtattcgtgtccagttgatgaaaacaaattgctatatctcctttgttacaagaaatctatggaagaatctggatagaacccagatagttatatttttgtttttacactgacccctttaattcaataaagacatcaatatgtgaatacataataactgacacatactactatataagtgttcattgatattgttatatgctgtttttttttaataatacttgtaaattttccaagagttttatctaatgtttctcaaacccagctgcacaacagattcacctggtggtcgtttaaaaaaaaagatttcatttcccaccttgggcctactaatcttcagggtgggtgcagtagcaaaacagagcttccattttctggagaagaagtgagacattttgagaaccccgttgggagggtcgtacacatcactgatggtcatttagaaagacagcaagatgaagcaaggagccagctctgagagctgcggctaaaagcaaagcctgtatccacagcaaatagataaatcaatatacacgtgtagtataaatgtatagaacacctggaaaccaaggcactatgctgggccctccttctgtacagaacacttaggcagtatgttgccccctttctttatgatgttttgcccctttgtttcagtcagattttacctggataggaggatgagcagaagaggctggtgtggatgtgcattttgttcctgctctcccagtgacagacattgaagtgttggccggagctagctaagaatttactttagacaaaatcctgaataggacccacacaactctgagacggattacatttaaaaattaatcctcggccaggcgaggtggctcacgcctgtaatctcagcactttgggaggccgaggtgggtggatcatgaggtcaggagttcgagaccagtctggccaacatggtgaaaccctgtctctactaaaaatacaaaaattagccaggcgtggtggcgcacgcctgtaatcccaggtactcgggaggctgaggtgggagaattgcttgaacccggaaggtggaggttgtagtgagctgagattgtgccactgcacttcagcctgggcaacagaacaagattccatctcaaaaaaaaaaaaaattaatcctctttcagtgtcaggtcccatttgctaatggggttcaattttcattcatctactgtaaaaccaaacaattcttatttgcagctgagctaaggggcagaaaaaggaggaaataaaaagcattaagttttatttccatgtatgcaacccagaaggttctaaatggttactttatttgagcaacttactttattaatagcaacttcttgtttaactagagcagtgttggaaaaataatttaacagaaattttagttagggggctacgggaggggtgggagatgaaaaactgaagaatgacgaaattcacatccactaatgtttacatttttaaagctttaatgtctgtttttaaggaatagttctttaatttaaaaaaaaaaaaaccttaacatattctctgtatactctagtgttggaacaatggtgactgatatcggagctttcagttggtacagtaataatagctaaagctcacccagcactaactgtggcagatattgtcctaagcactttacatctgctagctcattttatcctcccaagagccctttgagaagtttctgttattacctccaatttaagatgaggaaactgaggcaccaacggcaagcttgctcatgagtggtggagctcccctgttcatttaaccatgttgctgtattgcctggtgctgcttaccacaggtgcctggcccataggactttatgtcctggactgggcaaggttatagaagatgttttagttattagacaaagaaagccatgctgttccttccacacaccatctcattcaaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaactgtgtccacctactgtttattttcctccccctttttctttttttcttcatcaaaaagatatgaatgctgagatcatcccagagaaatctagaataaataccatgagaaaatagtccctctggaaggcgtcttgtactcctgctgtttgtaaatgtgaaaagctcagcaaccgggcagctggatgggtataaatatagcccacagcactgacgcccgctgaatcctgctttcttagaggcacaatgggaacccacggaagtcagagaaggagcagtaaagcccagtcgatcaatcagcctctctctttctctctctccatcctggaccttagtgtgggcgtgaggatagaagcagctttaagagtgcacttaaaatagctcttggaactggacattggctaagctcaaagacaaggaagatgcttcctatgaaaccgacctctgcctgacccttacctggggctattttgaccattctggtccgtgatcttagggctgtgttctttctcagttcagctgcttgggcacaagcaggttttctagtgcacgctccaggcgtttggcgcctctctgctgcctccgtactcagagatcttattctaactagactcagctgtctgaagcctggtgattaaaaatagcctcctggtgctagctgtggaatcaagggagagatactcagtgagcagagaggtcagcttgacgcaagacacctgactgtcatacctgtgggtttccttgcacctgagttttttatctcttgaggtattttccttttatactctatcagtgcccattttttatggctatgcaagataaaccagtcatttcagatttgtggggattagtagaagtctgcattttggcaggagaaaaccattattttacttggtggttcccagaaataaagtctctagttatcattccatgcagacatcaatgagatttgccattgaggcatacatttatttgttttctctttctcatttggtggtaaatacttcaaagtaaagaaccatgtcctctacttccgttgtaactgcccacaaaacttaataattcatcttacatgtcttgttttgtgaccgttgaactgaccgtaacagcctttctctgatgtccatggcatgccattagtaagagtcacaaatactgtgatactcgcctaatccatttttaaagtctgttcagggatagtctaagagtacaaggcatatgtgcatatttgcttttagttgtttcattcaatgtaagctggatctgtgccttacttttaacttctaagattgcttccttcaaattggacctcagcatataatatttataaaaataaagcaggaactgttatttggttaaagcagaatatacttaaaatattaaacttgggataacttagagaaagccctgaagttgaagagcttggggctctgtcagtccgctggtggccggagtgccccagcaccgggccttcctcacaaaacattctgcctctgattccctatccttggaactggtgcccagttagcaaagagcaccagctgttctggccttggggacgatgcatggaggaggggcaccctccaaggaaaccaggccaatagagccaaagtgaacaatttcagtcatcattgggaaccatgatagattatgtagcactttaatgattgatttcctaaaaaccattcatgcagtctttggaagttcagcttgtcacttactggcgtgccctccagggcttctgtccacatcgatttcaccactacatctccacccatggaaggcatgggccaaacccattcatattccagagaacaaggtgcagtttccatggtatacagaaaggtaatattgtacagtgggcaataacattccagttccggctctgctacttcctacttctgagcaacttggaaggttgcctaacctctccaaagacctagataaaatggggttaagaatagtgtccacttcatagggtggttcgaagaaataagtgaaaatataaatgtaaaacacttagtacagtgtctgtcacacagcaaggactcagtaaatgttagccaagaggggaggaaggaggctgccacccttatctgttagctcagcttcaaaaagcctagcaaaataacatcatgaatttgatctgagtggtcacagcaaatccattccctcactgatgaagctcaaattaccttggccacattctttagatttttccctttgcctctgaatgaagcattcacttgacgtagataaaatacagacacctcagcctccagttcagccactgtccagtcaagcaggaaagtacattgtgagtgagtcttaagtgaaaaggactagttatgatgcatttgagacaagaaagtagatcgagctttaggcttttccttttcttgccggaaaggaaaaaaacaacattgcattaatcatcatctggtcctcggccaagattcgtatttacctgttatgtgccatattcatactcaccctgtaatgtggcagcctcgtgccatttatcattccaacagcccataacagatgaggagacacagatgacttgtccagggtcatcaagcttgtcaatggcagagtgaatgttggagctcagaccttctgactctcaacccaatgagatacaaataaaatagtggaaaccaccagccagccctcccaagtgtttaggggcattaaagacactggccatcctaaaggcgcctcttactcttatacatcatctaccactgaaaccagagcttccgctgtgcactgtccatgcgtggggccgatcaaggacaccaaggctgtgcaatgacaggtttcttctctataaactttccttgtctctttcttttaagacattgaatagcactaagggataatttcttccttttcttttttttttttttgtgtgtgtgtgtgttttgatttttgacacaggttctctctctgtcacccaggctggagtgcagtggcatgaacatggctcactgcagcctccacctcctgggctcaagcaatcctcctacctgagcttcccatgtatgtgggaccacaagcatgccgcaccatgctcagctaatttttaaaatttttgtagacacaaggtctcactatgagctaccatgcctggcctagggtaatttcttaaagtagagctttatctccttgtcgagaggcatttagatgtcctttcttcaatgaaagattctttttctcctctaaagaacccagaaataatttgttggtcctttactatgatgtccctaacagatctaatcatgcctctccattttgagaccattcattctttcaaacaccattatttttattcagacagtgtacctagcaatagtcccggcactgggaacacagaaatgaaaagttactctctttaagaaattcacagttccaaaacctcggctgtacccacagagtcagggtcatagggaagtttcagtaccagatagtgggaggagggccagggctgccagtcgttggtgaatgtggtaaggtggcaggctgttggcagttgagagctggcatccagcattaaccttagaaacaaagagctcaaggagcagaaatccagccacagagactgggattcggtcataggacttctgttattgagaaggactggaagacagagctgggtaggaaccaagataggcatcccattacagcaaaggcttgtttttaggtggcagacaagggcacagaaaagccagcaggagtgactcaatactggttccctgaaccactggtcccaagcttcctcttgataaagggtaggcctggtcccggagtctgggtggagctgaacttcaaagtaaaggagggttaagtaagcctaactggaaaggttctgggccgtaggggcagacagccaagcatctcactgcagctaaaacccaagtaaaataaataggacttatggtatgcacaaatctctcataccagagaaagtggacattccaagtttgtgtgatttgaaggaaaagattttagttccgtggttcttgtaggttgttactagattgctagaatgcttataatataagatagttttgtgtgatgggtttatttgggaatgtgatgatagaaacaaaaggaaattcctttgttttttattaccatacaaggataagattttgagattatctttccaaggaaaacttatcaactatctattatgtatcaggcacaatcctttgtactgggattccaaagacaaataagatagttcttgacctcaaggaacttgtaattcgttggggaagacagataagtaaccaacaaattagaacgtagggtgattggagtgtgtttcatgtcactgcgccacagaagagaagcagttgacttaggagaggagaaagtttaatttgggccatgaaggaaattaaaagtaaagacctccaaattggtgggcagccattgaaggattttaggaaagtgatgtgctgagggatggattataagatcgggggcagaaagaccagttacaagggaaaatcatgctggtcatgccccagtacttacatttttctcataccacctcttagagcccctgaaagtgtagactccactatggagaagcaacacaaatgtgaaatactagcttgcgagccacgtgggtagctctttcctcttcaggaaaggggaatgctagtgtctagaagtgggagagattgaaatgattctgtaatgaggaaataagttacgttagggcacatatataaagaaacagcagaaaaaatgtaaaatctcaatcactctgtagccatgacatttataaaaatgaaaattttacaagagtatttctaaatgctttgaagttggcccccaaaaagcctgcctaccttcactttgagttacaaataaaatccctagtgttgcatagctgtgtgagtggtatttacattctcacacatttcagatctcttgagtccattttgctagtatttgttttccttggagataggagttaattcagtcacactttcttcccctgacaataactgcatttttttctctaaggtagctttccctccaaccgttgcttgttgttcttacccaagacccagtatctgccaaaacaaatgtatgtgagtgataaacgctgagaggaatgtctgttggaccacaggaaatttcctgttcaggaagagatcttgggaacttcctgtggaggagtgcattgtgggacttttggctgcagtcccttgaccacagctgcaattaactaaaggcagagggggaggggagaggaagaagaggagacagctacccacagacattcttatccatgtagcccgaggagagaatgggctcatacaggttcacaactttgcaagtgaactagatgtctagtgcagaacaagatcactgtgcccaacctcctttactgccatccatctttcacagccttcccggtgctttcctagggctcctaaaaacagtcactgtcacattatccatgtgcattccccagtccctcataagcacacatgaagtgtccatgccctctgtagccccaccaactgtttggaatctcttgattagcttctagaatccaggcattggagttggtggtctttctccatcccaacttaagtatgaaagagaggagaggagaacccgtggctctttgacataccttcatgtgaccctaaaagcattagggaaacgttatggaactgttacgaaaaaagaggttaataaatccaattgataagcacaatcaaaaccaacaggagaaccatgcattcttgtgctgcaatgccattacgaaatgaagtcctcgttaatacctcatactccccttcttggtccccaaactgggcacgtctactttgcattcaagtgcctgatgtgtgtgcgtgtgtgtgttttattttttattttttatttttttgagacaacctattgcctaggttggagtacagtggcatgatcactgctcactgcagcctcgatggcctgggctcaagtgatcctcctgccttagcctctgggtccctgggacagacaggcataccaccatgccctgctaatttttaacaattacttgtagagacaaagtgttgctatgttgcccaggctcttgatgtttctttacagccttcactcagtgcttttatggagtccatctctgaagagcagggcttatatttgagtttcaaaaatctaaagtctcagctggtggcaatttacatctgataatatatatgaccttggaagtctctggcagacataggaaaggggagtggacatctaaggactgaaaaatatcccaggccattttctgggtcatggaaaagtaacctgaccttcttatcccacctcctattcatcatccatctcacctcccatccccatcacattttaaattttaattaatttttcattggcagataaaagtcatatgtttatggtatacatacataaaacatgatattttaatgtatgtatacatgtggactggctagatcaagctaattaacatagccattaactcacatacctgttttttgtggtgagaacatttaaaatctaccatcttcataattttcaaacatacacagtgttattaaccataatcaccgtgttatacaacagatctcctgagcttattcctcccatctaactgacgttttgtatcctttgaccaacacctccccacccgcatcccttcttttactctgcttgagttcaacttttagattccacatgtaagcgagatcgtgtaatatatatcttttcattactggcttatttcacttagcataatgtgcaccagattcacccatgttgctgcagatggacttcaaaatgtaaaatattcttcatgagaatgaagttacccccccagaaagggggaccagttactccccagaaagaattaaaaagtagccgggcatggtggcacacacctgtaatccagctaatagggaggcttagttggggggatcacttgagcccaggagtttgagaccagtctcacagtctcagcaacatagccagaccctgtctcatatttttaaaacaagaattaaaaagcaagaatagtttgcagcaaacattttctgagacttttctagataatactaggtttagtccgccctccaaagtagtataattacatcatggttttaaaattaaaagcaaaaatataggtgaagcaaaagtgagctttattcatcgaaaatttgtcctcactcatcccatgtgactttttaaagtgtaattctaaggagactcccagcatccggatggcaaatacgtgaacagagaaacataaattaactggaagggaacaaaatagacctctcagctgaccaattctttgtagctttgacattggcctttaaaagaacgaggcaaacttttttaaagaaagttatctaatttaatgcaagaggtaactctctggctatgacttagggtaattaggcctattttctacattttggacgtgtttcctatggctggaatgtaaaagcttatttaatattgatgtaaccccaaaatttaagtaattggaatgcactatttctatcacattctattgagctgaagtataggttgtgctctgttcaattcaggttgtcttgacaaagactgagaaatagaatggccctccaagggcatacctgactattctgcggataacacagtcacgcaggcatttgctatagtgaaaatactgttatggttaagctagtggtatcttgtatttcaatgataccttacggtttaccagttttcatgtaatatattaacctatctcatttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcaggacgaccaatcttaagccatagcacaaaattcttaaatagactttacaatcatttcacctagtttggacttctggtggattattttgttctttgtcagcactccagcaaagataattactcctaaatcatgccttggattgaactgagctttgaatgtctccaatgttgggaattccgtaggttcccatagcagctctcctggcccagctcttagtttgaaagtttggtctcctaattagcctgaattttctctagtgacctataagcccattattgtaagccctgtccttattgtgtcataaaaataattgactccttgtcttcaatctatttcatataggtagacagctgccacatcaagaacgtcttgtaagtgcttgatttaccaaagtccatttctccacaagtttcttcatagttgttttcctggattgggggttattttagccttactttctaaaatgactggatttaatggaggcctctgtcagtcccaactctccaaatttctgccccagcttggtgctctttgctttgtttatagtaaataatcatttcagcatcagaataaatcagtgaactggacatgtctttaggtggacttttgagattatattcctggtccacattgcaaattagggaagaatgaaagaaattataattaactaggaagaaatttgtccgctgagaagtctcccttgttagactcctagaaaatagagaccataatattttataattttttgtcacagtttccatacatatttgttgaatgaatcctaaaagtcaaaagggagctgcttattggatttgagttgcttctagaacatgttaaaaattatgtgaattttctcaatgtatttgtaagaataagctgtcctcgtgattgagtattgatcttcaaaatggagaattatcagtggtgagtgatgctgcatgtaatgtacttataaaggataggaaaaatattttgtaaaaatgccttgggataagctttaaatataaaaatccaaaatggtgatttagtttggggcactcagaggaagaataagaatagggcctgtttaaattttttgcaacatgattactcctggttttacatttgattttgtattatagaatgagattaactggaatatgttataaatacagaaagtctgtcattataaacactagtcagcaccttttgtcttcataagaataattgctattttcaatgcatacttgctctaaaatagaccatattgatgtcataatatgtagactgagcaaaaatattattagtatcatcatcatcatcatcatcttctgatcttcatcaaagttgtattaaaatattttggtattctaaatatcattatcttttttgaaagcctacttagggtaatagaaggatcaggaactttggactctttgacagatttctagttttttctatttttttgctattctgtaaattctttcaaaagatttttatcaggtgtttactgcatactctgaagtgctgggatatatcagtgaccaaaacagatatgacccctgccttcatgttgcttacagtttaataggggagataagtgtctaccaaggaattcacactagccagagagcacattgcccacacagcatccagagtaatctgttgtaagataaatcagactgttacttccctgtgccaaaacctccactggcttccagtttcatttggaaaccttctgagttctcagtatgaactgccaggccctgtgtgatctgaaatttgtaaatctcgtcaacctctccaccctcatcctccatcaccttgtgttctgctagttcctcttcagccaccctgatctttttgctattcttggaacacacaagtttatgttctacctcagggcatttgcacttgctgcccttctgcctatgaagctgtttctccagatactctcatgttagagtccctcaccttatccaggcctctgcttaaatatcacctccttagagaagcttccccaacagcattatccaaacgacaccttccttcactctccatcacctttatcctgcactatttttcttcttggcaattttcaccacctgacatgtaattttttaaaacactggatggtgacccttaggtatctattcaaaatggccattcttgtgcacagctggggtatgatgccagtgggtccacctgtagggtaattggatgggcctggctgtctcatgggagactccagagtcttttcttttgggaaggcaagtttgtccaaaaagaaatcctgtgggctcctccttagaaagagtcaatatatgatggcacttgagcttttaccatgaagatttccactgagttcccctatattccagagctgctcacccttgctccctcctgaacttggcgttctcagattcatcctgattccagcaagggaaatgtcctttcatctgcaaggaggtgcaggttgctgggctgggggagggtggaatacagccatgccacagatgctttattagtcttctctgttccctgcctgccttcagaggcacttggaacccccagtttctgaggttttatgaagttctggtaggaaaacgagtttgtttattggtatctccccctgcaggcagattgagttaagattttctgctcagctgagtcagataccaattgtccgtctgttccagcttccaaaattttgtgcacctccctcaactgccattgtttcctctcccattctgttgtcttgtgggtttgtaccttttttattcctctatctggtttagtgggacgtcagacaggagcagggatagacaagatatgtctcatcaatgtagttacatgtggaggtaaaagcattgatgtagcagtacaggatgctttgaaagcataaaatacagaaatctggtctggtgtgtcgcatacatttaagaggagacttgaaagctaagtaggagttaattgggcaaagaagaaggtaggattatttctggggaggggaacagagcctgtgaaggccctgagactggaagaggatttgttctacagggaatggaaagcccagcccaactggcattcattgaatttgctgtggaaaagcagagtgacacattgctttggtgaggattgcagatggtgaggtagaacaagacagtcacgttaaggattttgatctttatcctaagagcaacaagcatccgtgtctgtgttacctcagtaaccttggacctcgtaaactctgggttcttttataaaccaggcacagtaatatctacctcacagagctgtgtgcattgcatgacatcatatacacactatattgacttaagactgtcatatttgtttgctcaactcatggatatgaagggcagactgtataccttgtcaggtacttttttctttttattgtatcccatgggggaaatggatggtagattggtggaggtggctagaattgtaaagaaaaatatgaaattcacatgaaggctggagttactcatatgacaacaacagcttatggggcccaattctattgctcttgcgtctgtcacacagttgaggttttggaatgaactacgtatgccatccttgttggacagtgacaagtcactgtagccccctaggagaagaacagtataatcaagatgtcaggttgaggaataatctttgtgatcaactgagtgaaaggtacaaagtaagaaacaattgagaggcattgctctgggcccaaaagtctagtaacaggcaattagaggttaaaggataagcatttgatagtgttctagctatactgcaaaatgaatgctgcatgaaggctaactgagaagcttatcagttggtagttgggaactaaagaggaagcaggcaccaaggaaagatggaaagttctacacacctttgttagttacacatggaggtaaatgcattgatgatgaatctgccatttttaggttttcatgtttaaaaagtttcctgacaatgtgtctagcaatgtgctagacactgtagataatatacaataaaatattaaagaggcggctcgtcctcaaggaactttcaagcattcatacatttctgtttgattgtaacatatttattattttaaagaactggccagagagttgcatgttctgtgtagggataaatagcaagtttcaggcccctgcatttattggcacttacgtacatggtagtcctcacacctttgccggacagcaccaaaaatcctgcggagctcaactctgtgacctcaccctttgagcctggaaatcagcatgaactcatgatctgacaatcccgaacaagctaagcatttcttaaaagaaagcagtgacttttaataggtctcactgatggtgttccaccgattaaatcagtcaaacagaattgtcacattgaagattatcttgggtttctagaattcattctaggttttaaagatgcagacagattctgagggtcacaaacgtcagtttgccaagtatgtttaggctgtaaagttatccatgaaaagaccgtgtggtttgcatgagattgattgtgatcggatgtaactacattgctttttacagctcagtagaaaccactttcaattgcaaattgtagcagaagcaggcgtctacttaattttgatcttaaagaatttcaaagagaataaatgcacactaaatagtggtggattttggtagtatacgccaacatcactttttatttaacacatgcagaaatgtgtactggtagagaaaattggtagagtgaattaaagtacagacagatccacattgactttaaatgaatacatgcacggtcagaaaacggtaaccctgggcaggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataataaaataatatgtaaaggctaaccaaataacccactttagtctttacttactggcaggcagcaacatgtcctatttacagagggaggctttacctaagtggttatatgtaaatgaaccaccttttcaatgaaacaggatgcacctgtctagaggtgtctgttactagagcaatggatgtttgattggactgacaaattttatttcctttttggaaaaaagaatgtaggtggtatcaaatcaccctttctcctggtaacaataggaattacttcttgaacttgagaaaccagtagttgcttgacctatgttttttgcatttagcatagtcttctaaagtagtaggagcatacgtttttgtctttaattccctgcagaccccttccccaatgatcatcagcaatacatccacccataaatcaatgaaatcataaaaaagaaacataaaattcacttgaaaaagaatacctacaaggcattcctagaattctcaatgtaagtcattttttgccagcaaagctaattgttctcaaatatttgataacaaggatggcatacgtagttcattccaaaacctcaactgtgtgacagacgcaagggcagtagaattgagccccataagctgttgttgtcatgtgagtaactccagccttcatgtgaatttcatatttttctttacaattctagccacctccaccaatctaccatccatttcccccatgggatacaataaaaagaaaaaagtacctgacaaggtatacagtctgcccttcatatccgtgagttgcacatccgtgattccatccagccacagatagaaaatattcagaaaaacaaaaaacaaaaaaaaaaaacccacaaatgcaacaataaaaaaatacagactttcagaatagcatataacaactatttagatagcatttacattgtattcgttacaagtaatctagagatgatttaaaatatacaggaggatgcacataggttatatgcaaatatacaccattttatataagggatttgagcatccttggattttggtatctgggcggggggtcctggagccaatcccttgtgtatgcagaggaatgactgtactggaaagcaaagtaaagctacaccaaagagggtaatagcaggctataaagtactgagagaaactaagagaagaaagtgaggtacctctgacaaaggagtgcttggaagagaaaggatgaatagaaaaatgggatttcagggaattcattgatgacaggatgacctacttaaaaatgacaagggccatgtgtggtggctcacacctgtaatcccagcactttgggaggccaaggtgggcagatcacttgaggtcaggagttggagacgagcctggccaacacggcaaaaccctatctctacaaaaaaatacaaaaattagctgggtgtgatggcacgcgcctgtagtcccagcttcttgggaggcatgaggtgggagaatgacctgcgctcaggaggttaaggctgtggtgagccgtgatcgtgccactgcactccagcctgggtgacacagggagaccctgtgtcaaaaaaaaaaaagataggaagtgagcaaaagagaggtcatagataatggcatgatgaaacagaggaaaaaaaggataagaaggaggaagaaaaaatgtacaataaaacgagaaggaaggatgcaaaatgaatataggaaaaacaagagaactgaagacaagaggaaaaaaggagatggtagaagggaggaatgaaagtaagtaaaataggaatgaagttcaagatctatttagccatagctaaaggaacgtattatcagctattgatttcctcttctaataaagaggagaatgatatggatagtccagaataatggatcatttgcaaaacattaatgtgtcttgacttaaggtacatgtttataattacctcgaactgtatatttgtcttcttccatgtgtggttttaaattattttaccaaaatggggaagccaggagatacatacttgattcagtaaaaccagctttttattcgtagtttacttcctgctgcatccttttttcggctgagagggatcaatgtctgcaggtgtcccttaatccataattaaaccatatgcacatctaccctcccagtttccctgcccaccataaaaccttcatcttggctattgcttggaaaatggggagggaatagagcttctgcttttttttttttttttttttttttttggagagagtcttgctgtgtcacccaggctggagtgcagtggcgtgatctcagctcactgcaacttccgcctcccagattcaagcaattctcctgcctcagcctcctgagtagctgggactacaggcacgcaccacaacgcccagctaattttttgtatttttaggagagacagggtttcaccatgttagctaggatggtctcagtctcctgacctcgtgatccgcccacttcaacctcccaaagtgctgggattacaggcgtgagccaccgcacctggctggaatggagcattttacttgagacctctgtgagctggtcctgagtatgagtagtgaattccaacccacttttctcctaatccctgtcgtgtcctagagtgagaatatacagaggggttggaagtgggtttatgttcatgggctttctagatggactttcaagtccaagtagaagtccaacttgagagctcgtgtagaaagcccttgaatgtaaacccgtgaagaaaagcacttccttatttcagaaagagcacaaaagaccagcaatccaaaggcatttcgaagaccttgaaagagctgggagtggcttaggtatggagggtgcatgtgtgagtacaaatggcccctcagctcagaaccaagcatctgtgtgccatgatccatggttcctaaatatcatggagggcaaaaagtataaatgtgaattaatgcaagagaaaccacactgaaataaaaaatacctgtggtctcttgagattcaagttggcaaaatccaatctaaaagatgtctgactatcacaattagtgaagtccacaggtcagattttcctctctgttcctgattaggattaacctggaaaggtggattgggtccatctttaataataactacaccttctgaaagatttgaaactattattatctctttgtttgctgctgctttcatagatttatggtaggacttggggttagatggatgatccaggtcacctattccagcctcacactctgcctctattccaaatatgacatcactgagcgatggccacccaccttcccttggatacctctaacaatgggaatctcactgtttcacaggcagctcttttttttttaaacacctccaattccaatttttaaacacctccaatgtccagaaagttctttaaactcttaaatacatgacatttattaaaacaaagcctcaaaccactttcagagtggtggtacagcaaataattgattcttttcagggtttttcccccctgtgttttttgtcttctctaactcaaatcattgcccggatattgcttataacaggagctcagcctcaaccagtctttctgcttttaccacatgctctagtggaatctagattaccggactcatttcgaatctaactaaaaatgagaaatgctctgtttatataaagcttggcaatcaataggaaaaggaaaggctgtttagcaaaggccagtgataattccaagaagcagtgtcttttggaatatgctatggtgacctggccactgcagctatctgcttatctgtctggtttcagatttccagaaaggactcgctgccttcgaaacacttcccagcccttccttgggtgcctggatttctaccattagcagtttactccttgagcatggatttttgcagaaagacatgtagaccagggagatggctcattaagctcttggtggtcatttcaccagagcatttagcatttttaaatcccttcctggatgcttgttttagtgatgatggtggtggtgagatgaagcagggatgtgtagatcatgaagggatgggaaaggggatgatttggttggaacgaagcaaaataacatttctgagtgcctgctaaggtccagcacttttcacacgtaaaattttcacaacaatccctgtgagttgggatccagtttctacagatgaggaaatgaagacaggagactagatgacctgaccaggtcctaggccagtcaggaacagagctgggatttaaaccagagctgcctggtccaaaacctgtgctggtcctgctattttatgacacctagaagggaaaagggcagagaactggaaagctgagatggaatcacctacttaagaattttgcagaaggctaaccctgtctaaaagcatcgctttgcaatcagacacatgtggcagtaaaaatgtcccaatgctaactcattttaagccttggttttagtctacctaaaatttatagaacactgtaaaatatgctacatgtaataagatatttattaggagtcttcttgcacttgttcagaatgctttttattatgtttctgctcattattgtagatattctcccattttggagaaattgaccgcgtgcacactcttcactggagttttgcacaaatcttaccagaaaactggtgaagatcagtcctgaggccccttccgcctctaattccttgcagtattttggctgtactatgtgctgttacactagatcacaataagcagctgccagtttcctcacaggttcccttggggaaggatatgggaataattcttaggaaccccccacaaattatagcaaccaatgcagtaaaacccctttagctcactcctccccctgtgctcactcacatactcaaatatatttagtgctttccttcctctcactccgacacttttgggagagccctgggggtggttgagtaccttgtccttgggtggattttcttgttttctgagactggctgccatcagacttcgggagaggatcttaccagaggcgggtctcttcttcccccgccaccgccctcagtattctttcacagccaccacaaagccacgctttctctgctaagtacacattcctaggactgtaacaaaaggcttctgtgagtttgaaagctgcaggggaggctcctgcgtgaaggcctaagatttaaagggtttcatttctcctgtgctggggactgtattgagtgcagtttgaaatctgcttcaccaccacaaggggaaatagaaatcagccctaaagctgcatggagaccccggctggtctttatcctcatagcttagtgatttcctgccacccaagaggcagtgaggggctccctgacattccggaggccccaggaaccctggctgcggtgacccggtgctggggagggagtgcatggggtaggctcctggttgtgagccttcagttcgccgggatgtctatgctgtgctgtgtggctacttagccaaggctgtgcatgccagccggagccaacagcttcagcaaacctgccctccggggagagtggatttcattgttttcaaagagatacaggaaatcagaattttccatccttccatggagagacttggattggactgagaagagaaccagcattaaaaaggaagtctccttccctttcttccctgcccctcctcaccccagccccagcccacccgccaggggcacaccctccctctgccggcctttgggtggaaaccttcctgcctgcagcacaggcagtgtgaactgcggggctgtctgagcaacccagctcttgccttttcagtagcagaggtaatgtggccacgactcagaattatgggaccccagatgctgaggaagtaaactgacttcttttcagctcacagcagacgcatagacaacagagtagatttcatgttctaatgaaacagtgtagaaactctgtccttggtggctcagtactgtgtggtatgagcctctgcctccctccctccctccctctttccttctcttttcctcccccaccccttcacggcctgccctttcctgattcttcagaactgacaactataaatccagcccaaattcctttaaacaaagggtcaccaagagcacgaccttgaaaagacttcttgtgatatgcacttgcagagttgcatattgttccttggatttaggacaggccaaagaaatcttccactttatttaagaagagcctgtgtggttcgaggccagggccgtggacataggattaaccacaataataatacaatgaagtacacatgcaaaatgaaaacttaataatgaagaactactgattttttccagggagtatcaagcacttccttgtaaattcttacaaggcatgaattatttcctagaaatgatttaggctcttttggaaaagtgcattgattcttttaacatcataattccagttacggtaaaacctccattatctgattttctgtgaattgcaaagctattattaactggtacattttatattttaccagtacagtgacagctgatatttataatggtgaccccaaagttctgtaaaatgccgaattacccactcaggaatcaaagaaagattaaattgtgttaaatagagtttttcatgttaagtgtcttattttattcagatcttgttttagaaagtccaagtgtacatccaccataattttcgagggcagtaccaacttaaaatgttttatcttttcttggctttgtaaacaaaaccttgtaaaaaaaaattttttttttcaatactttgggttcaaactacagatcattcgatctcaaacctgacaggtaaacaaatttttttttcagagtaagtattgcagacatgaaagatcataaatgtgttcaccaaagtgagtgtgagacagatcaccccaaacactctccactatttctctatgatcttagcccagctgtgtgtgttgtgagtcatgcctgggtctgacaccagcattcagaggctggcatagcttagcatccacatcataaagggctcagatcgatggctctccttgtcaagctctgcagccctctctcaggctttgtgagatgtggtttgcatcattttcctttaaggaaatgttatgcagaaacataaatgcagtatacaacgaggaggctttcaccaagaaattaaaagggtacagatgtctaggaatgcaggggttaagacaaaaatgtactgcagggaaagaaatgtgagcagaatgcccctcttttcgcctgcttctgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgattaaaaaaaagaagttactcccactttccagatgagaaaacaaattcaaagacagtgagtgccttagctgagtcctatccaagcaaggcagggggcaaagccaggactaaaacacaaggttctaattccttctccatgatttcctgatgcccatcataccctaatagaataggatcaccctgcaaggcaactggtccacatggagagtcctcttggaggacaccgacccgtggtgccacctctgatttgcaagttggtgcattagacaagccctggaatgacagccagaagatctctattctgatcctggccctccgtctacttgggccactttgatcaagccatttagccccgttcccttcaggtggctcagctggaagtaagaatgataatgcccatgcagctgactcacctggtgactgtgaaggccaaatgagatgatgtgtttgagagcactttgcaaactgtggagtattgccagccatttctcctaatttggctcagggcagaaagacatccaggtgaagagcttgatgtgtgtgatgacttaggcttggggatatttgtgaacaggacacaacaaataaattcgtttgacgggcagagggacagtatgctgggtatagtagaaactcttggaacctgcagttattgaagggtttaaaactcaaaaatgatacagaaggcagttctattacagtttctgcttttttgctgttcaacacctctgaagatggtgcgtttaatccttcctgggatggcaggttatagatgacttcatgctgaaagtgacccgtaaggaatatccgtatattttgaagtgtatgtggttcaccaggcagaaaacagtctgccaagtctctcatcccaggcagaaggggtggcacatgcgaaggccagagaatgcagtgcctctgagaactgtcagatgtcagtgtggctggagccaggtctgctagagggtgaggttggaagttaaccaggagtttaggaggccctgggaagcctctgaaaatatttaagcaaaaacagttagctttatgtttttgttgttgttgttgtttgagacggagtctcgctgtcacccaggctggagtgcaatggcgccgtctcggctcactgcaacctctgtctcccaggttcacaccattctcctccctcagcctcccaagtagctgggactacaggtgctcgccaccatgcctggctaaattttttgtatttttggtagagacgggggtttcaccatgttagccaggatggtctcgatctcctgacctcgtgatccacccgcctcggcctcccaaagtgctgggattacaggtgtgagccactgcgcccggccagctttatgtttttaaaagatcattgcctcgttcttggttctcagctctctgatccttttagtttttattggatagaggagagaccttaatgtatacagagactaaggaacttggaattggaaatctgcctggctccctttccctcaacgtgcctgcagtcagccatctttctccagctaagccaaaggatggtgggggcaccacacaacagagagctgagttagaaagggtgggagggaggtggctgaagggtccccactgcagttgacaatttgaaataaactcccactttccttcaatattttcctatagcaaatggaaactttgaccagataccagcttctttccatccttccattagactcacagcccagttaggatgttcacagtcccaagccagggatagcacatgccattaccatagtgggctggatagggggcaggaagcaatgctttccagcccttagaagcctctggtgatgtgctgtgaacatggtgagggaacccgaactttagagtcaaacaggctggtctgcaaaccccggttccagcactcactggactcaggatcttcccaagttagttaactcctctgaccatgtctgcattttctcatctggaaaatgggaacagtaatatccaccctccagagctgttatgaagatgaaattgaaagtgtctccaacgcaccaggtatatagtataatctcaatttatgcttttgcccttagatgccagaagttaatattctttcaatacttattctcgtagaagcaaaagagatcctgtttgtgtgatgttcctacagcctctgctgtactgtattatgaaagctcaagaaataggagttaatgatgaggcacagcaggaagaaaaatgtctctaagatgccaaacagggaaaatttaggaagaaataagaaccaaaaaataaatcagttgatcagggtaaaaaatgtcttatgctctgaacttataactctatggagtaatttccactaatgatctcagtgtctacttaactaatcatgtacttttctagccagaaagacagtacttgtagggtacgttccattttaatgcacaaatcattgttgcttttcaaaaagtcatctttttttccctggccacacacagcaccccgaggcctggccagcccccatgccagctcaagagcatgaactcttaccggaatgggttctgtggggagtacaaagtcaaacataagtaggcttgcattcagagctcactgcctagcgggaaaaaagacatatgcactcataactctaatttaacacggcgtcctagaaattccatatccatcttcaaagttctctggaagcaaaaagacaggaggaaagacatttttagaaggaggcttcctggaaggagtgacttcagtttcaggccttaaaggagatgtgagtttccacatgcaaggagggaggaaaagcatgttgcagacagacgaagcaagtgtgtgagcaaaggcctgcggggtgacagggaggggtgttgggaggtgtgtatctggatgaaggcaggtatggaaagtgctgggaaaaaaggtctgggaaagggccttgggggccaggtgataaggaagttgaatgcctctttgaagagtggggttttattttatgtgcctttggtggggagttgtgaaggtttttattcaaaagagcagtggggctgggcacagtgactcacacctgtaatcccagcactttgggaggccaaggtgagcagatcacgtgaggccaggagtttgagaccagcctggccaacatggcgaaaccccatctctactaaaaaatacataagtaacaaaaattagctgagcgtggtgatgcatgcgtgtaatcccagctatgcaggaagttgaggcacaacaatcgcttgaacctgggaggcggaggttgcaatggcctgggattgtgccactgcaccccagcctgggcgacagagcgagagagactctgtctcaaaaaaaaaaaaaaaaaagcaatgggaatggttcttaaggaagatttctctgggcacactgtatgttctcactgaatatttggtgtggtttgggttttataccagttacgatatggggcttggtatctctgagcctaaaatctgtgctttccaaggacagtagaaatgctagtgttcactttgctcagtactcttccctccacttggcactcatgctgcttctcaagccttggggtgtccctggttctggagtccctcctacccctgcagcccttttctaagctatagtctcacccctcctctgcaggctcccaggcagcctcacctcctcctgcagagggatcagctgtcaccctgctcctccctcctggccctcagcctaccctacccacatgcattcaccatcttaccagtggaacaggcgtccctctcctgtatacagaggtcccttcccctgagctcttctgcctcagcctccccagtgggcttctcccctccttcacagtcagcctctttctcatttgcacctagttccattccatcttcaaagaagcccacttggattgcacatctctcttcactaccacaaatctggttcctcacagccaagttctggaaagagttctccacatggtgtcctcctcctcacctcccattagcgcctcaaccctccgtgatctggtttctacgcctgctgcccctctgccctggctgcagtccccagatgccgaatccatctgccatctgctgcccgaaactctcctggcttgcaagataccactgtcctctgacttgtccccggtcttgtcccctgctgttccctcctttaagaatacaccttttctaaattgcctgctgcctaaatgttttcctctggaaaactcacctactccagcggcttcaacgatcatcagtgcgatggggacttccaaatattttttatctctagcctgggcctttctcttaaataacagatgcatgtgtacaactgcctactgggcctctttacctagatgttgtacagttacctcacattcaacaaagctgaatatatcccccgccaatccatcctctgtgggatgagatgggcgggcccctctattcatctagtttcaggaatcaggagcttggattttgtcattgactgcttcctccacattgaattaatctcttaagttccatcaattctaccccatggtatcttcagcccatcctttctccatcccttctgctttagttcaggctaacaatatctgtcatctccatttctgcaacagcctctgactggccgccttgtaccagtcttgccctgttctaattcattctctactctgcagctggagtgatcctttgaaaacaatatccgattatgttacgcccttgtttaaaattcttcagtgactccttgtagccttaggataaagcctgaactccttagtacagcagacaaggccttccaaggccttcctaataatagctaacacttatgaagttcgcaatccataccccacactgttctaaggtccttacacatatgtcaacatacttaatgctcataattcctgacgtaggtcctgttactatccgagttttacagtggaggaaatcgaggcacagaaaggtaaggcaccttgcacaaggtcacacagctaggaagtgggagaaccaagattcaaacccaggaaacctgactccaggcccacactccttagcaccatgctgcactgtctccatcatgtgccgtagcttctcatccattcagaaatattatattgagtactgaaaatgggctagaagctgcttgagacactggggatatagcaggaatccaaacaaaggtccgttcacatgctagtgaagaaaatgagtaagaaacagcatgattagtaaaattattaggtagattagggatgaatgctaagagaaaacaaaaataagcaagaaagaagaccgggggagtctgagaacagatatgcgatgttagaaggagtgtccagggaggacttgaaggaagtgaggatgtctaggagaagaatatcagctgaaggaacagcaagtccaaaggccctgaggtgggaatagttcctggtaggtctgaggaacagcagagaggtcagcgtggctggagcagaatgaaggagggaaaggatgatggcaggaaaggatggtgggagctgggtacagacaggtcaggtcatatagggcccagaagatcattgtaaagaccttggcatgaactgtgagtgagagataggaagccactgggggattctgggcagagtgacatgatgaaacttacaaacagaggagtgatgtgatttgaatcaatctctggcaggtctgttgaggatagatgcagggaaggaacagtggaagctggcagaccagtcagggaccagtaacaatgatccaggcaagagaggatggtggctgggactaatgtagtagcagcagaggtggcggaagtgggcagagctggatacatttggaaggcagagccaataacacttaccaatggaccagaagggggtgtaaaagaagaaacaaggggctgggcacggtggctcacgcctgtaatcccagcactttgggaggctgaggtgggcggatcacaaagtcaggagatccagaccatcctggctaacacggcaaaaccccatctctactaaaaatacaaaaaaaaaattagctgggtgtggtggtgggcacctgtagtcccagcttctcgggaggctgaggtgggaaaatggtgtgaacccgggaggtggagcttacagtgagccgagatggcgccactgcactccagcctgggcaacagagtgagactcagtctcaaaaaaataaagaaagaaagaagaaacaagggcgactggaaggtgtggggccttggccacagaaagaatggagtttgccttctctgtgatgggaaagattgggaacagcagatttagatgagtgacatctggaggttggttggcctcattaagcctaacgtgcctattaagcatcaaaatggagatgttgaccgggcacagtggctcatgcctgtaatcccagcactttgggagtctgaggcaggaggattgcttgaggctagagtttgagaccagcctgggcaacatagcaagaccccatctcttaaaaaaaaaatgtgttttagattagccgggtatggtggctcacttgtagtcctaaccacttggaaggctgaggcaaggggatcacttgaagccaggagttcgaggctgcagtgaaccatgatcccaccaccatacaacaactctgttgtctgggcaacagagggagattctgtctcttaaaaacaaacatggagatgcattgtcacctcccaccctcacccccatttgaacacacactcacatatatctcacgtcctaatcctactgaactactcaacatttccccaaaccggttgtgctcttttcatgtgtgcaggccttgcatccgctgttcctctgactggaaagctgttggcccatccagttgagaaagtcttccctggccgtgcacgaatgcactaacttgtaaatgtctctttacattcctttcttcccttccagaccgcaaaatccagtctcattcaccttgacatgccctgcgcctgatccgggacgcgaggcatagtgggcatctcctaggttagacggatgggtgagtgggtgagtgaacggagaggtggacaaaatgagtgctcagcagttagacccaactgtgttttgatggtagtgatgggaattcccctggcacatggccaggtgagatgatcattcagcctgaaatgaaagaaacagcagatgtcaggaagtttttgttaatcctgccttgtgcgttagaactctcccgcatacgtcccctttcccgcacactctctctacctttctcccccatttctagctcctggtcttattcatctgtagcatcagtaaacatataccctttactgttcacatccaggtctgtaggggaaattttggttataaaaccggaagagtgtttaacctaatgtcctgctgcgggcttgctttccacgggcctccgggtctgttaaaatgatcaggcctcattatttaggaagctgcctcagccaggcattactaatttgggcattactaattcagatgcctattcaggcaaatgagcaatgaatgtaaagtgcttttgtcagtgaattgcaagtgaagagaagagggagtgggggaagtaaagggaaagtgatagaatgtttgagctttgcttcatttccagaaaggacagccattgcttcctggaagctgggcttggcaacaggcatggaggaatgggaaagatttatttccctttgccaaagctcaataattcagcttgagtatttcaaatcaatacatttcttgcaaagtttccaagggctgcattaaaacagccatttttaaaaattatcagtacatgacagcatcctccgacgagactggcatgtcagggatgagtcgagtcttccaaatagacaagactccagtgagaaaggaggctgccacaagcaggaaaagcgaagttagagctgacagcaagaccaaccgcacctgtagggcctctggcgttcacacacctcattggttttgtgggggctctttctgagatgagcagctggatcgctcctcctaagggcttgcatgggggaatctgtgactataactccgtatttctttgaagatgcaattcatcactgaacttgggaaagactaacttggggaggtctccaccacgatctaggattgctaagatgtctgacaggctgagtcactcatacttttgtgaactattaaaaatttcatagttctgacatctggacatcttgactttcggtgataggagatatggaaagacagtaaaaggctgtgtctttactgttgttttaatccccactagagagtcctttttttctttttttttttttttgagttggagtctggcaccgtctcccaggctggagtgcggtggtacgatctctgctcactgcaacctctgcctcccaggtggaaatgattctcttgcctcagccttccaagtaactgggatgacaggctcccatcactaggccaggctaattttttgtattttcagtagagacggggtttcactatgttggccaggctggtctcagacccctgaccttgtgatccgcctgcctcggcctcccaaaatgcgggattacaggtgtgagccaccgcacccggccagtaattccttctatttcgatgtttcatcttcactagaatcgttccttagttctttcggtgggagaagccattcagccccccttgactgccagtgccctttgaggctctcagccatttgattcttcctgtgtatcccctgtggttgttgtctctgtttctagagtgcagtggttcctgcactttgggctgtaaccccctttggtggggccagagaccccttagattaattatcacatttctttcacttactgccacaaaacccagcagcgattcactaggagaacccgaagattggtgctcttctttatgagacaccaaaggggctctgtgtttcccagcatgaagtcttcagtgacagagtctgggaggacagcacaggcagcagcagtgtaactctcagaatccccacggaagagcagagcagctcaatagcaaaaccaaaacccagcgacgagacatccccaagtcccaccttaatgggacttttggtagcctttggaacagggaaaacccaaaaatagccaagaggtattcaccagaaagcctgaaagtgggagtggttttgctcgttcctatagtagtgagggcaagtggcgtcgaggaggtctgaaaggtgtagagttctctgggccctgtgaactctgccactaaccagccacgctgatggccagctttcaggatagctgtggagaagctgctgggagtagaggcacattgaaaaggttagggatggccaggcatggtggctcacgcctataatcccagtactttgggaggccgaggcaggtggatcacctgaggtcaggagttcgagaccagcctggccaacatggtgaaaccccgtctctactaaaaagacaaaaattagccgggcgtggtgatgcatgcctgtaatcccagctattcaggagactgaggcaggattgaaccctggaggcggaagttgctgtgagcctagatcgcgctaatgcactccagcctgagcgacagagcaagactccatctcaaaaagaaaaagaaaaagaaaaggatggggcagcagagacttagatgcaaggtctcccaaaggaaacagaaccaggagatttcagaaagccagctgccatttatttgaatgctacatgaaaacaatagaagagagggtttgctaaggctggaaccatgccatttcataaaaatttcggaacattgtcttcagatgaaaatgagcaacagaaaagtagtgaggtcaaatcccacacaaagtttttataagataaaggaacagaaggagcagaatagcatccctcaagaaagcgtgccaaaacaacatgcctttagaacaattcaaaaccctacttacctccaaatgagctaaaaggtaagaagaaaaagatacgaagcgtggggcaaacacaacatcaatcagaattagaaaaacttccaaatgaaatgacagactctggaaagaattaaaagtaaaagaaaaatcatttcagaaatgaagagttaactagtgagaatacaagatgaatctttacaaaaggtgattttttaaaagagaaacacaagggggaagcaggaaattttttaaagaagaaacaagaaaggttttaaaaacaactcaagaaaaagtgacaaatattgaagaacggcaaagaaatttcaccacgtggataataggagtctctggggaaaaaaccacaaagcaagctttcgcctgcatcgctcctgtctctgcccctgtcttcacatggccatctcctctcctctgcgtctctcctctgtttccatataaggacacctgtcattgaatttggggcccacctgcataatcttgagatccttaacttaatgacgtctgcaaagagccattctcaaattaggtcttattcacaggttctggggattaggacacggacatttctatttggcagccaacattcagccatctccagtcactgagctagtaagtgacaaaaacaggatttgaatttcgttgtttcattttattataacgtggttaagagagattttaaatatttccattaagttagcaattcttgccaacaacagtagaaagcatgcctttttttttttttttttttttaaagtcagagcctcattctgtcacccaggctggagtgcagtggtataatcatagctcactgcagccactcctaggctgaagcaattctcccacctcaaccttctgagtagctgggacttcaggcatgcactaccacacctggctaatttattttgtttttcaaggagatggggctcttgctatgttgcccaggctggtctcgaactcctggcctcaagcagtcctctcacattggcttcccaaagtgctgagattacaagtgtgagccacaggacctggccaacagcatgcttttacaaatagtagggtagcaggaggccagcctgcagaccgcccagagacctcaccccatcttacgctctgcccaacctcaggggagcatttttgcacttggtggattagcattacttgctccatccatgatgagccactcatgctcttcacagattttccagactcccatgtcaaagttaaaaaacagacatcggcctctttccagaactcagaatattcacatctatattgttaacactcataccttttccagcacagaatgaaaagcacctttgaagaatcgtaagccatgaatgatgacgggccgaagggagtgagggctcctacctcttgtcactcctaccatcctgcctccaggacccctgccacctacttgggagtctgcccttaaaactcaagggtcacctgactcattcctccccactcattcatctgactacccaccaaagctaagtgtgaacagcctgtattgatttatcattttccttttgcctgcttcctctggtacagagatcttcatgctttcatccaaacgaatgaataatgtaaaatcccaggtggggtgacagagccaaggagaaaagtgttctgcagcaagggagggcctcccagtatgagccttggagtctcagataagcccagggacaaagcatgagacatccagttacatatctgtggccctggaaggggagacggggttcgctttgtggtggtgtttagctttcctgactccaagtgaccatcttaagccaggggattagtaacctttacaactctaatactagggaatatattaataactggtgagaaaaaagattacagcttttttattgataggtctataaaagccatttccgtatgaatgtcctcagaaaggaggaataaggggatgagatagaatagaatagagagaagtctgtctcacacacacacacacacacacacacacacacacacacacacaaatgcaacacaattatctttaaatagaagttgcttctccaagtttgtttttttttgtttgtttgtttcatgaggcgtcagcaacgctgttaaaatgatttcatcctgcctgtgtgtcacagcagtctgccccgcgaaatgctgaatcagcagcagcccagacagcctttcggtggagggtagattcgacacccaaaggcaaccaaccgggcctttgaaagcacttggaagcactctccaaagagccagggaagaggacaaggaagaagggggtgcagtggaattctccttaaaaaacagcatgttctagaaaagccatgctttggaggtgctgtaggtcagatttgcctttgggtccctatgtgtattttctgaggtctgttcatgtaaaagttcaacacctctttcgcactcccttctcccagcccccgcgccctgcccccacacctcctgtccacctccacctcctcctcctggaattcagtgattatcaggactgtctccatcctgagaagaggctttttaaaatttcgcaggagaatagagacacccgagagggctgggaacaggcacagctgagccacacaaagccaagcctcctccatgcaagtgacggacagatcaggtcccagttcagaatgagaatgagttttactctggttacactttgcacaggaatgttctgcagactgtgccgggcaccagagatggtccgtgtgcggtttaaaagagcaggaggggaaagaattttcatccctctttattcaggcaccctcaggagagtatccatgttctgtgaatcatgcaaatcctgcaggatctttatgttctctgtaccccatccatttctgctgaggattacaaacattcttgcaccaactttcctccagcagtttcgatttctcaataaatctgtttgaggaacatttcaactcttaatatctattttcctactttttttttcttcttaaactcaggcttctttgtaagcatacatatcagtaagtttgataataaaaatgacctttctgccctgcagtataggaaatgctgccttaatgcctctttgctttagaaactcatccttgtatagtatctctccttgcatagccaagttgcctcattgtacgtaaattaaggttatttgcagtgattgaccctaactactatgaagaaaaactttcaatatgttagcaatgatgtctataataactgaagaagggacattccctatttaaggtcaggactgtgcgtttcaaataaagaaatgacagctcaaacatttcattgtacccccacttctaagtgagaagagggcacccttcgtgtctctcttttctgtttttctccctgaaatatcaggagagacatatatctctcttaaacctgatttggttttcgcattacctcacaggtacatattgtcagaactatttgcatacacgagactaaaaaaaatactaaacggattctccagggatccatggataaacttgaggtagtctataagctttgaaatcacaagcaaatatttgtgtccatgtgcctgtgcattttgaaggggggtttgtttatgaactctggctgaattctcaaagaatcctgtaccttcttcctaacgctgagaagtacttgctctaatctcttccccactccctttttgctgtcccctccccattatcttttttctttttgatatggactttaattaaaatgttgatgcttacgtcaccatacattttctgcattaattttgatttttaaaatattgcgttacatgacttaatcttgattactgaaactttttaaaggtaccccttaaattttgctcctggggcaaatgtcttacttgcctcagcctagcctggggcctgagcgggcacctccttcagccttctttcctccaacctctccctgatccaggctgttttccgcaaccccacctgagccattttcccagcctgcaagatgacaattcagtcccctcctcaaagcactgtactgggcctcatagctcctgccagagccgtcatgcaccttccaagaatgcttgctccagcttctgcagctccagggagctgctgaaagtattttggtcttctggagacacgggacaaagtacaactcatctactatccagtccttgtcctacccaaccccccaaaatgcattgagcacttgctctgtaccaggcactgtgcaacatctctatagggatcacctcatttcatgctcacatttgccctaagaggtaagtactattctggactccatcttaccgctggagaaacagattcagacgcgtaactaacccagcgctagtaagtggtgcagccggtgttttaacccaggacaatttgactgcgaaacccaaggtctgatctaaaatgctacatggctctcaccacattgggcttgctacccagaagcaaaaatgagaagaactcttctaagtcacgtttgtgaggctgagcggcaagctctgggtcagttttgctgtcaacaggttttctgctaaaaacccgtttgtagctaaaactagataaaagtcagaaaaatccacaaaatgaagtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaaaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaagcaatccaccggccttggcctcccaaagtgctgggattacaggtgtgagccaccacacccagcccttaaatagttttttaaatataaaagtaaaacatgcttaatagagaatgagaaataagaaagaaaaaaggaaaaggagacagggaatatcacctacaattttactgagtgtcaattctttgaatatttttacgtttcattgtatttttctatgcattgagattattacatatgtacacatactatttttcaatatgaatacatactcttcatcatgttactggctgcattaattttctatcatagatattgtcagtaactattacttatttccttattgctgttcctagtttttcattattaaaaataacactgcaatagacatctttgtgcatgaaagattcttccacatactaagttatttctttaaggtagattctgagaagttaacatttacagggttcttaaaatatcactaagttgtttgccagagagatgatgccaatttatcttctcactgttttgtgagtaccagtctaatgagctccgatttttaaaaagatgtatataatggatgaaaaagcaacttaatgaaaagaaacatataaaggagagtttctgagctctagaattttaaaacgtaagtgagctgaaaaccatggaatacgcttaagaaaacaataaatgtgggcagcaggataagaataagcatgatgtcagcctgctgatggggttggatggggtaacatcagcaaatggcaaagaaaccaaaactgttcaacttctttctctctcccatgaaggagaatgattgtcagactgaaacaggtagtgcaaacattgacagaagggaattgaagcctgagatgggtgaattgattgtaaaagcaaactaagttctgaataaatgcaaggctcttggcccggacaaatgacatcccagggtcgagaactcagaggggtgaaagataagccactggcagtgatccttcagggttgtgggaaatggaagctgtactaaaagaataggaactgttggtaacctgattttaggaagagaagctggggaaaatgtgggtacgaaataaaacagctaacctgatggaacttccagataaaattcaggacagattttcaaacatacatgttacgagtggaagacattatcactttggagccagccatctgctcctcatcctctctcctcatcttctttaataaggttgctctaagtgttgtagttgctgtatttcaggatatcaggaaggcgtttcgttgaatttctgatgttgctttcatggatgagcttggaaaatgtccaaaaaccagagtatttagatggattgatcattgaacaactcttcccaaaaggagtcaataacttgatcagtatccgtccaaaaggaggtgactggtgtgtcaccagggtactcccatctcagccctatacgatctgcactttgtcagtaacctgtggaggtgacagatgcttagcaaagccacagatgacgtgaaattacagagtatagatgctagaaatcgatggaaatctggagaagactgcagcaggctgggatgatggttaaaaataataagataaaatgtaatatcaattaatatacattcttacagttgggttccaagtgctagctatatatgttcaggtagggtgagattataaaggtgattataacaataacagtacaaaagcaatagctaatgttttttaagtgattgctctatgccagatattggcctgtgtgtttcatatcatcatcatgtgtataattttactctacactagttttatgtcatctgaaaattgtataagtacattatctatgattcaatgatatttaattcacaggatgaaagttgtcctcatttttcagttgacaccagcaagacacagagaggttaagtaacttgtacaaggtcacacagctgggaaatagaggttccatgcttgtgctcagtgcctgcatgctgaactaccgtgaaactttttctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgtaaaaaaagaataataatcattgcagtgataagattcagtgtaaatgttcagtaattgctagctgttactatcaatagaagtatattgtccagagaaagaaaaatgctagtcctgttcctactgctgcgtttaggaattgaagccacatagatctctggaggaggcaggcaggttggtaagggtctacaaactgcagtggaggagttatctttggaccaattaaggacgtttcatctggaggcaaaatgactaagcaaggacgtgataactgtcctcactgtgttgagggttacaaaattggtgtgggtcattgaatcaagttatgagacaacatgggatgttgggaaaagtcaggggatcaggggcaggttgatcctgagtcagtctcttaacttccaggcttcagcttccatctttcacattttatgattctgtctccagcacgtagaacctagagcaaattcctgtttatacagaaagtttggataaggagtggttttgctgaatggctactgtagcagaaaagcttgaactgagtgttgctcaaatcaataaaatcacctgatgactaagccctgttttctattaaactgaaaagagaatgcaacagacttcactgggcttttgtgagaattacatgaggtaatatgtatgaaagcaccttatcaactctgaagtactaccccgatgcaagcagttatgttgattattgccatagctagattataacttttccaagaattagaatataatgaaacacacttaagcattaatctgtcttctgtgattcagaagatccttcaggaagttacaaaatctcagggtcatggccatgggcatggagtaattctgtagaaaaagatcctggctgtaaggtattctttggttttttggattcaaattaaataggagcatattgactacatgaaaccctgaagggaatagagatcacatactctaagcccgtcattgtacagatgaagtcactgagccacagagaagctgagtggcctgcccagaatcaaatgttaattcatggcagatctgggaataaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaagggcctgggtgtgtcactgaaggatatgacacaatatactggacctactcgggagaggggagaagtacagtagaatttttagtaactttcttaatcacagcagttcactttctctgtacaaaattcttttcaaatattctctgaaactaattggcattaaaaatgctgatcttagtaaatggccctcaagaggcacgctatgcgcacagggaatagtataatataggtgcagagtaatggtctctctccttctctcctttttttccttttcctaatgatcattaacatctatattctttgactttgttgaattaaagttgcaagagatggccgtaaataaagcaagttatgtatgtgcctccctcattctgcccatgcagcttctgttccatttgcagctgtgagccgtgtaagactctcaagaccaagcacccatgagtgcctgggagcaagtagcctgtgaagggaggactttattcctggatgcattaaaagcagagtcccacctacacctccctcctcttcccatttataaatctacttctccagggatctacagattttttggctatatttttagtctgttgataatttgagaaagtctccaaggatctaagtcttggatgggtaggagtcaattcactcagtcttttttgaatccctaatggatgttcaaaaccagtctcaattctggatctggatgggacatgcatgtcgaagtacagtgtgatggataagagcacagattctggaaccagattgcctgggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaatgggaactccctgtgtgaaggagaggaaggtccataataacaaatcgcagcgccattcttgttcaaaggtgacaccattgacagtaaggagttaggtttaaggtttttaccagttcaaaaactgagattttgctgagtaaccctcactgccactcccacctccctgtgattctagatacgtgttttcaaggtcattggagagagctggtacttcccatatccatggactgtttttaataggcatcactttctggccagtcaggagtcaaaaacaaaaacttttagtggctgtattttattctaaagatcataaagcagtaatgcaccataaattattatttgaaattctaatttgtttccatgtgaaaaaaaaattatcctaaaaacaccaagaaaaaagctcttaaatgctcatctctaatgatttccagtgcccagtagttctttttttggtgcactacaaaaaaggaattttggttttgaggggacttccacaggtttagaggaagccaactaccattcctcaaaactacactttgcaaaggagccacttggaagacaatcatgcccagaggccctggacattttccagggcatttgagccgtttgttccccacttcagcaggtaggaagagcagccccatatagcaaaccagattgttctttggcatgcctggtttaggatgaaaggtaattttttccaggatcaaactgagggacacttttataacacacttgtgaagtcttcgtagcaagtttaagtaacttatagtgagagacggaagctcctcttagcaacactgatgccattgctctgtttgagctattgattcacaccatgtgattttagagaatgaagatccattgaacatccagcttcttctgacccagcagttcttaaatttggtctcatgtctccttttgattcttaaaaattaatggagaccccaaagagcttttgcttatatgggttatagttatctgtagttaccatattattacataaattaaacctgggtatttacaaaatatttatgaatttagcaagtaaaatagccaactctatattaatgcaaacatattttaaaatatattttcccaaaccaaaaataatttgtgagaagagtagcattgttacacatttttgaaagtctcttaaaatctggcttaatggaagatggctggacgctcatctctgtttctgcattcaatctgttgcaagatcacatcatatgccttctagaacattccacctaagaaagaatgagagcgaaaaaggcaaataattaatattgttatgacaagatgttttacttcataggcaccctacaaaggtctcgggaaccctgatgggtcccaagatcacattttgagaaccactgttctaacttatcaaagatttctcacaacagcaaaataaaataaaactatagacttacagtcaggctcccagagagccaacctgagccaacctctcagcccctgctctgtacccccctcctgcccacttggttcctactcagagttcaagtaccaccccaccaggaagctctaatgtcagtgagtagaataaaaaggcagaagaccttttatccttactttgccctcttattgccagaggccagcctgatggtttcccagaggctgagtgaattgctcttcctggaagaagtttcagggaacatttcattatttggcagctctggaaggtcaagctcagctctggaacattctttcttcagaaggacgctgggctgcaatcagatcagctctgaatctgaggaccctccaaccacactgacacgtgtcatagttctgagcccctgtgggtgctgtgggcaccctggaacagcccctggaactgggcaaggaagggcaggtctctaagacctaccatcccttaaacacataaaagatctttttctcattttgcctctaaataaaaagttaatctgacagcacaccccagagtagggtttggtgtacaaactgctccctggactcctcttggaggctgcttctgggcttcgagaagcccccagtggggcggctcaaacaagggctggagaggggactcagagttgaacataagggctcttgagatgtggagactcattttgttaactattcagagaccttctccctttattccagctgtctaactgacaagacctttctctctttctttctgcctcatgctctctccaacaggcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgagagtctggactcttggcatatgcccaacttggaaagtctcttagttagtggttggtctttaacacccctcacccggcccaagaaatcccaacagtgagtcatcacaaggaagggatgacgatggaaggaagttgaaggaagattatgctagcatgagccagtttgagggaagaagaggaagtgtttacagaccaagggggagaattttaagtttaggagaggaacccagtttagtcctacgtacactggaacttaagggctctaactgtgccactaagaagaaaaagaaggctggccgtggtggctcactcctataatcccagcactttgggaggccaaggagggtgaattgcttgagcccaggagtttgagaccagcctgggcaatgtggcaaaacctcaactctacagaaattttaaaaattagctgagtgtggtggtgtacacctgtagtcccagctactcaagaggctgaggtgggaggattgcttgagccaaagaggtggaggctgcagtgagctgagattgcaccactgcactccagcccaggtgacagagcgagaacctgtctcagaaaaagaaaaaaatgccattttggccttttgactctctaaaagagatagctgagagtgaatgcaggctgtgaactgctcaaccgaaaacaaagagaggaaggagaaggacgtagaagggctagaaaagaaaatagaactgggggaactgcagataaagactgggaaatgggagatcctagtagccaaggccagtttagaaaggcttcaagtggtttcccttagaagtaggactcgtttgaggtaatgcatcttgtagcctgtagaaatcctaaaaaatacaagcagaggtctcctcgggctcatctgactcagaaagcttgtctaattaagggctcctgataatgcattagaagatttccattcagtaacaagcatctctacctgcagagtgtattgctcatgtggataaggcttcaaagatttgtctcagtttcatttcctaaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttcttttgaatttattacaaaatacttcccttttctattccagtggaaactcagagatattatactcaaagaggcaacgttatatatctggaggaaaaatccctacctctttgtgttccaatgaaaccattcatgtaaagcaagcaaaggaaaatacagtggtgggttttgacttgatttgacttggaccttgggcaagctttcctcccaagtctctataaatttccccttcatcctatctcaggtgcacttttttatagctggtttattttcctccacagtgacctcttagcattatttgtgaaactgggttctctctgctcagagctatgaacaaagatacgtgaaaatctgtccgcagttccttgccactttgtcgagtctttgtcaggtgggccatgtggaagatggtgctgctctcaaggaagttactgtccagttagaggcaggattgcgttgatctaaaaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctatatagatcagttaggaggtggcaatagaaattcattccatgagtattcaccaagcaactctatgccagaggtacacaggtacaggctaagggagttcagagattagaggggccatttctagctggcttgtcgaacaaacctcatagacaaggtaatggagcctgactttgaaaactttgaaaggcaaacaagaaggagatgaggaagcatgttaagaaggagatgtaggccgggcgcggtggctcacgcctgtaatcccagcactttgggaggccgaggcgggcggatcacgaggtcaggagatcgagaccatcccggctaaaacggtgaaaccccgtctctcctaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaagaagaaggagatgtaggctggtgtacatggaagaggaattcagagacaagactgcacgtgctagacactccctttgaaacatggtcgaacatcactcaccatgcctctccggcttgtctgattgcctcctcacatttcaaactggtggactgtctcctggaaggcttctcttgactcccatccctacttccctaattccattccactttcctttctcccatcttgttctacctccatctaggctaggtgctgtttctcctttatcttagagcattctttccctctgtcatggcccttgacacagatacacacacacacacacacacacacacacacacagtgttatacattgtttgctgattgtttgctactccggatccctcccctagagtggaaagttcaatgtgggcagtgattgtgttctattaagtcgccaagtctccagtacctaacaccagggcatggcttccaggtggcactcaacaaatgtaggttgaatgatgacccggtttgagagtacccaggttaagaagtttgggttttattttacaggtaattggaaccactggaaagttttgatcagggaaatatgattggagctctctttttgcaacagacattttccaccagtgcgtagggtagattcattggcttacttaaagcaggaaagctagttagagtgtccttgctgtgatcctaatgggaggcagtgaagcccagactggatcagtgagatcaaaataatactcaggcacaaagtggctagctaagatggggagctgacttggaagtagtggttagagttcatttttaaagcaagcaatgccaggacattcaagaaaacttgtcctgatctgcagttggacatctaaaacaagaggcaggccagggctgggaataatagatgtgagcatcatacatcgtctccattatgtagaattttatgagctggggataaagataaatttatacggaaggtaatttaattaaggcacccactagaaagccatggacagaatttcaaggcgatgcctgccagcagggcctgtaggaaaacttaccacagaacacaggagtattgcgaatgggtttataagacaactaagttggagttgagaagacccatctgatgaaggggtcactcagcaagagggggaaggccacaggcatcctccttaggcaggggcaagatctagattgaaaatcctttttattttccagatgtaacatttgccactgtttcttctgacatgggctttctcctttagcagtttggtgtagtgaaagtcctcaggcctggcttctttctacacctggcccttcacaaatcacgtcacttcacttggccttattttcctcatccacaaaatgcagttctcaccacatggatcctaagctcccttccattcttaacagttcagcccaacttcaacactgaaacagtgttaagttgctagcaaacaatgtagctttctatgctctctatatatggaaacaacattctttaacacaactcctctccaatgtagagaggagagcactggactcaatgagttataattacctggaatacgattataccttaagtcaaatacagtagactccctgaatgccatattctttgaccagcttaacaaatttatcgcatctacttccaggacaagaatcctccattttcaacccctaggataaagcagggaacatttgcagtgtgctttaaataattatatggtctctaaccagaagatttcaaggttggagacaaatggaatattttctttggaatagtctcccagttggaggatataacagatgacaagtttataacatttgtaaagttaaagaataaatggaagggatcccaattttataaaacgtcacctggacagaataattttacaaagaccttgggctactagatagttatcacattaactggttctgaagtgatttaaattcagagaggtatttgagtacttgactactttgagactctgagaaaacacattgacaggagggaacagacaggttggcatttatattaacccttacttagggttatccattgcatgacattcaggtggaatggatttaggtacccattattttctccgaacaaggaaacccacaagttattatcaatttaattcatgttacactcacttgctatcaatgctaaaaaagggaaagaaacatatgttcagagttccttcaattcagcaaaactgtattggggatttgctaaatatattgaggattttagtagactaaaatctgcagtcttttcatatactagagtgtgattttgcaaattgtttcttccctttccaacccaccagaacctttgtctttggaaatatgctttgcttatatttttcaaatatagtaaaattttctttcaaagttaaactgaaaatactggtctttacatagtatttcttgaatcaaaattggcctattaatttctattaagcaatggtaggtttgccagattgaagggctgtgtcaactggctattttagaattaagtcagagcatccaaggatataggtcacagaagggaaattgtagccatgaaatgtgggagttgtagcaggcatgacccttgtctgaagacaccagagttggctctttctttactgtgtctttgagcaagccaaaaaaaaaaaaaaagtgtatcacacatcagagaaatgcttcgataggtcacttacgtgaaagtcattttatttcttttcttttttttttttagatggattctcgctctgtcgccaggctggagtgcagtgccgtgatctcggctcactgcaacctccgcctccagggttcaagcaattctcctgcctcagcctcctgagtagctgggactacaggcgtgcgccacaacacccagctaatttttgtattttagtagagatgaggtttcaccgtgttggccaggatgatctcaatctcttgacctcatgatctacccactttggcctcccaaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaatatttgttgctaagtaaaagactaatttatttttgtggtcacagaaggcactccagattaaattaaaaggttaattcaattggcctgcaaaaatgcactgaatggaatgcttagaaactaggaccaggctgggtgcagtggctcacacctgtaatcccagcacttaaggaggccaaggcgggcagatcacggggtcaggagatcaagaccatcctggctaatatggtgaaacctcatctctaccaaaaatgcaaaaaatcagccgggcgtggtggcacgcacctgtattcccagctactcaggaggctgaggcaggagaatcgcttgaacccaggaggcggaggttgcagtgagccgagatcacgccattgctctccagcctgggcaacagagtgagactccgtctcaaaaaaaaaaaaaagaaaaaagaaactaggaccaagcagagttagaaaaccaagcagtcccattacaggaatgggcatgttatgcactggtgttttcactgttgaatttattatgtaacttaagggaccgaagcttagggcttcatcctgaacccatcaaaggcagaaagggcccaacagagagaacattctgacatatctaaaaagtacctctcccacaccaggcatactcttactttaaaaaaaaaaaaatggccagagggaatctgaagcctctgaataaaaatcaaagagaagagagagctgtttgcaaattaaagaatgtgttacttagataatctacgtgtaaggatatgtacatagcaaatcatcacctgaaaaatgcagattttaacaatgttagggttctactttaaacctgctaaacttgagaagttaaaagttgcaaaaccccctgggagaggctctaggtagcattgcagatgatgcgaaacattgattccagccttctgagaacaagtagcgtataataagaacgtttaaactaatcatacactttcactgataattctattcctaagcaaatagccgaaggaaaccatccaagagtgggcaaaaaaaaaaagatgcccttaacaattctatttatagtagttaaaaactggaaattccccaaccacccccactgtgggactagctaaacaaacttggggagagtaaatatcatgggatacacggtagcctcacagccattcattcactcactcactgattattttttcagtagattttgcagggctctgcaggtcatgttcaggattttacatgtttgtttgaagacaagtagaagccatttgttttttgttgtttgtttgtttttgtttgttttgttttgttttgagatggagtctcgctctgtcgcccaggctggagtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatgatgtcaactggggaaaaaaattccatccatatgaatgtgactttgtaaaacttacgcatgtgctttaaatacaaaagtactgaaacaaagaacattttttgccagattttgtgagacatgtctgttcacgcttatgacaattgcaagagacaccatccattgagcgtttatgatggcagacgtggggctggtgctctgcacgtatcatctcatttaatccttataacagccctgccaagtctgtggcatagttctcattttacacacaaaaatattgaactaagccctgaactatggctcggagaagaaaaatagcttccctaagggcatacagctgacaaagagaggaacaagattcaaacttgggactcccttgctccagagcccaaattctttcctctaaaattaagtaacttaaataaatttaacccccctcaacagcatcttgcatgttcttggtcctcagacattagtaagattgatcagccaagtcacagcagtattgttcactcgctctctcctgtccatttggaacacattacaatacaataatggaatttaggattctcaaagaacgtgcctggcttttcatgtaaagatcaccaatgcaaaactgtgttttgtttctgtgtgtgcgtgtgtgtgcgcacgcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatcccagagactgttttggcgttgtttgtttgtttgtttgtttgaaacaaggtctcactctcatgcaggctggagtgcagtgatgtgatcacagctcactgcagcctcgacctcctgggctcaagcaatcctcccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggaggctgaagcaagcccatgcagaagcctgggaggtgtgcggcagaccacgtgtcagacccccagaggcttagcccaccaggtcaggatgagacgtccagagaacccaagactaggagagtggcctcagttaaccttctttaccctttctggaaggggaacgtaaagctggccgtgacccagatattcctctattctccatgtgagacctccttagagatctacacacctgtcccaagccactataataatatcaggaatagtaatgatgggagtgtttgtggtggtggtggtagtggtggtggtagtaaaatcaatgactagtgtttactgagcttttcctgtttgcctcacgccatgatgagcttgttacatagaccatcttattgaatcgttacaacgatctcacaaggtagatgccatcaacactgccattttatagatgaggaaactgaggccaagtgacattaaagggcatgcccgaggaggcaccagtctgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttcctggcctccccttccaaaatggatacactaattactggacctttttttttttagtaatagtaatcatcaggaacacatttttcaatgttttcatttttctattccgcatactaccaaaaaaaccagataaaacccagcaagtgtgaggccctgtaaattagcaaaagttcaggaagtcattacacgaaaccaaaagaaacaaagtgttgattaggggcttatttttgtatgagattaaaatatgaatcattaaaataggactgtatttcaggcttcttatccccgcctcatcagagacatcaccatgactactaggtttggattcaatgaattccgaagccgttctcagctctcaaatgcagtcatgtgtgccatggttctgccttatacatagcagtttcaaaagtctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttccctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaacatcctcacaaaaaataagagcaataaattgggatagtttaaattccctgccattgttcggcagctactgaagcagttcagtaatgtgggaaaatgttcaaaacctaatgtggagggaaaagaggatactcaactattaaaagcccgcttctaactatagaactatagatagtattaacagggcttctgtatcttagtgatgatgggattctaggtcatgttttgttttctttctgattttctgcctttttaaaacatttttggggccgtgcacggtagcttacacctgtaatcccagcactttgggaggcctaggcgagtggatcacttgagctcaggagtttgagaccaacctgaacagcatggtgaaaccctgtctctactgaaaatacaaaaatcagctgggtgtgttggttcgcacctgtagtcccagctacttggagggctgaggtgggaggatcacttgagcctgggaggtggaggttgtagtgagccgagatcgtgcctctgcacttcagcactggcaacggagcgcaaccctgtctcagaaaaaaagtatacgattttcataatcaaaaaagtttgatttacaacttcacatcgctctgaccttttgagtttcaagtgctgcattctgtgccccatgagcttggtgagggtaggaggtggcaggtgcgctccaattgtatctttggcaccgtgccaggcacttagctgctgctccgtagatcgttgttggaaaaacatctttccatttctcgatttccctttcctttttctttccaggtgatgtgctctatgaactccttcagcatattctgaagcagaggaaacctcggattcttttttcaccattcttccaccctggaaactctatacacacacagccggaggtcatactgcatcagaaccatgaagaaggtactggaagaggtttctcttttcttgcctgaggtttagacaaatccaggaagtttaattgttaacttgataagctggtcttcttcgtgtaagttcacttttcattcagtagacaattattgagtgcttactatgtacaaaatacactcttggttccctgaagctcacgatcaaagcgaagcagtgagatggatgtacacagaagcacagaagcgtaaccatatagtaggcaccgtaaaggtgtggtggaagggtccatgacagccaggtgcaggaagcagggtcttctcataaaggaagcaactctggagtatgccttagagcagtgctccccaccctttttggcaccagggaccagttttgtggaagacagtttttccaccaacagtggaggtgagggatggtttgggatgattcaagtgcattacatttattctgcacttcatttctattattacattatcatacataatgaaataattatacaatccaccataatgtcgaatcagtgggagccctgagcttgttttcctgcaactagacgttcccatctgggggtgatgggagacagtgacagatcatcagccattagattcccgtaaggagtgtgcaactagatcccgcgcatgcacagttcatgatagcgtttgtgcttctatgagaatctaatgccgctgctgatctgacaggacgtgggactcaggcggtaatacgagcagtggggagcagctctagatacagatgaagcttcactcacttgcccccaccgctcacctcctgctgtgcagcccagttcctaacaggccatggactggtaccagtcagtgacctggaggttggggaccccgccttagaaatccagcaggattctgataagcaaggatgaagtgaagaacattccaggcaaagaaaatgacgtaagggtggggtaaggctttgaaatagagagcaattagatgacttggattataaagcttatcttctcccactcttttattacagaaaatttcaaacatactccaaatagaataaaataaataaacccttctgagccatcacccttgccttcacaatgatcagcattttgtcattgcagagctagtccaaggagcttagcttggaaccagagtgtggagaactttgatttctggaatatggaggaaagaaatgggaagtcattggagagttttttagcaaggggtaataaaagttggaagaaggaaagaaaaaaaaacccaaatctatgaactcagtgttgggccagggctttctgcatagggcaccaaaggaggctggttagagttcactcagtggcggtgtttatttcaagtgtcccagttgttcctcttaatcattggtagaaagcaaaagaccagaatttaatttaggccctggacctagttccagaataggtgttggggcacagaaatagagtataaaaaccttacttgaggccaggcgcggtggctcacgcctgtaatcccagcactttgagaggccgaggcgggcggatcacgaggtcaggagatcaagaccgtcctggctaacatggtgaaaccccgtctctactaaaaatacaaaaaaaaaaaaaaaaattagccgggcatggtggcaggcgcctgtagtcccagctacttgggaggctgaggcaagataatggagtgaacccgggaggtggagattgcagtgagctgagattgcgccactgcactccagcctgggcgacagagcgagactctgtctcaaaaacaccaaaccaaagcgaaaggaaaccttacttgagcaccattgcattaaacagttgaacagcttgagcactcagtgatggatcgtgcctctgagggtcatgatcctcctgctcggattggtcagaccacagacgtccaaacgtgcatcagtttcttcatgtgtacttttccttaggtgcagattactagggacctcaaaccctggtcccttggggcatttccttaaaatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggtggccctctccctatcctcctgcctttcagctatatggtgcccttgatgacaaagagaacaagtagagaggtgcatggatcagtacaagtttcctgcctccagctacttcctctctctctcccttcttctccactgaaaagaaaaaaatccagctcaacataaattgtttccagaatcaatactgttccatttaattatgaaggataacagatgattgatgtgggcatatgttaacatacagaaagatctggttctgaaaaaaaaatctgtcaagtgaaattatacatatcaaatattacttccccagtgatttattttacataactgggaatacagttccatataaaagtatgttaacccaagatgacacatgttgctgccaacttggcataggtaagtaggtaggtgggtaggtaagtaggtggataggtggataggaatgacagaatggaaagagaacaaggcccaactcagctgttaagcagcctggcacaatgaagcatgcacggtcaagtgcaaacagaaggcatcattcaaccgccttgtgatttcacctcgtcgtggccacaaacttaaccagttcagacattcataatttcacaatgggcatttatatcacagtacaaatgtgtcttgctcaatctagcaccagttccccacatgtatcctctatgactttcttacattgaaacttacattgaaatcatgccttcgttagtagccacgtggcagtgctagaagctaggaagttggtgttagctcagaggttcacctccatgccctgacagtagacgaggatgatcatcatgctaattcaaactctctatatgtgaacatttgttacctctataatgtactccattctgaaatcacatcatggcttgagcaaagcagtcctcagattacacttacctctagaaaaaccagcattttcactctttttccttacttattagttatgggaagggagggtgattttatataattaggttaaccttataatttttcacccataccaacacacttatgacagtgacacagggctccagcaataagtaagccaggactacatatcaaatattcaggcaaaaccagaaccagaaccatcctcgacaaacaaactggggtgagtgtgtgtgagtatgtatgtatattttaaaggatgagatctggaaaccgggaaaccaggtcctaacccttcattctgccagaacagatcataagggctaagtttctcattcctctggctctgtctccccagttataagaagggggttaggctaaatggtttctgcagtctcttacagctctcaaatccccacattacgtccaaggaacctgagtcttcctgggtgatatgaagataagacatattcccttccctcagggtcttgagcatctaaaatctagaaaatcatagcagtgtcctgcctggtgttgctcagaagcgggagaaaatctcttctttcctcatttgtctcaccttattcagaacttcagataatgttgcccctctgagagtggcagcaagagtagcgtcattcacttatttcatcataaaaagctcagtttaaggacattctttttccttgactgttgtgactcattttatctttgtaatatgaattagaatgcaggtaggtagttatgtagaaaggaggtaaaataaacaatgatattacttccttcacaaaaaccaggaggcaaagcatctttagaaatatcaaagcagtaaatgactataaaataaatttattttgtcacgtgcagttgtgatgataacttcttttcacaccttaggttcttttattttgggttttatccccttaaatatatatatatatttttttttaattgtcatttgtcctctagtgttagaactactggaatattggccccccaaaaactcaacggaaacataaaataagcctcccttctgggctaaagtctctgaatgagaccagctccacagaatcaccccatgggactggatatgcagtctgtagggagaaggagcaagatccggatttctcaaacgttctcatcccatcacccccttggagcttgataatttcagctctttagttgcatcctgtcctctgccccatcaaagagattatggggcagtgattcttaatcactttaatttgcagatattcacacatgcagggctgagattgtttctgtagcactggatgcagttttaaggtggcagttctgctctgggacagctctttatcacaaggtaaacatggaaatcgcaagtgatgaggagaactttcaagcatcgaagtgcaattgatctcaatttttcttacaactagcacatgggaatggctcaataattgagagaagtcatttctttgtgaaagatggagagggtggcatgtgttctgcgatggcccacagaagttttatttatatgattgctttattgaggggaatcgtacccctcctgccccaccaccaaacccaagtgcccaaagactgctttggcagaaggaagttgtatacaattttaatgagataattaaagaagatgaggtatatgaatctggttttttttttttttttttttttttttttttttttttttttgagaaggagtcttgctctgtcgcccaggctggagtgcagtggtgcgatctcggttcactgcaagctccacctcctgggttcactccattctcctgcctcagcctcccaagtagcagggactacaggcatccgccaccatgcccggctaattttttgtatttttagtagagacagggtttcgccgtgttagccaggatggtctcgatctcctgacctcgtgatccgcccgcctcggcctcccaaagtgctgggattacaagcatgagccaccacacccggcctgaatctgcttcttaataacaaaataatagctaacatttattgggtccttgttgtgtgccggccctgttctaagctcttatatctttgaatcatttaatcctcaccacaaccctataaagaaggtgatattattacctccactttatagatgaagaaataaagattaagagcaataaagtaacatgccccaaaatcaagtagcaacgctgagatttaaacccaggtggggttgatgccagtgcctgcattcattccactgcgcagaatgaggagaccaaaatacattttcataaatatttgtagtgtaggcgccctgaaaatagagcacatgattgaaagacgagtagcagtagtggagatgagaacgccaaagcagttttcaggtcagctgactggggctacagtgtgtggcaggtcctgcttacattactgccaaatttgtactaaacaatgtcaaagatgacttctgggactccaaagtatgtctagttcataatattaaaaactcatgctgagttggaccgaattcacccttctagatcattaactcccttgggatgggccgtcttagcatcacgaaaatctcccagcctgtgagaactgtgggttctgagccaggcaccggcttctgagagcagacacactggctgtcacctaccccctgaggagccagcccctcagtgcaggtcacgccttgaaagctggcccctctctacagcggcttagtaggtaacaggtagacgcattctttagctgctcaagtcacatcctgtcactggttgtaaacccactcgattctctagtcttgctggaatcgtgttgatgactgcagggtcaaggaggctgtgggctggggtttgacatctttgttacacatattaaccacggaatacatgacagagccagagagcatgccggcacgtatatgcgtgcactctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctcaaaaaaaaaaacaaaacaaaagaagaaagaaatgagttaatacggaaaatgcccttagaatagccaagcattcggtaaatgttattcattatcatgattcaatatttctggctgttatttggttgtttccccccctctgtttgtgtaaatttttaattgggataaaatacacaacatttacaattttaaccatttttaggtgtacttcagtagtggtaagtctattcacaatgttgtgcagttggtttttccttccacttttcttaaccattctcaatatcgcaactacatccactttgtgcaaacatcaggtttgtgcaccttatacgtagggaagggccattgcctccctcactgttatccaagaacacctttgaggattcatctgcactatgatttctgtgggaaaatacatttaaagtgccagtcttcattactctcagaacacggcctgtttggaagtaagcactgcttgcattttatgtccccttgcagtatctggcgagcgctgggtcctccatgacccctttggaacctttgtattaatcttctggctgtctcctttaagaactacaagattaacctttttgcagccctttctgttctgggattcttgaatctggcagcaggtaacgacaggtcccatcagaaacaggtcaagatcttgacttcctgccctccctgggagcagggcccacgagcaccacttaacacctttttcccctgacccagcctcattccagccttctgcaagtcctgctttcctctccaggacctttgttcctgctttgcttcctatatttcagggcctagggcagcatgaccttttaccttctgacccttgcccctgctgcagcatgtgttttgtgacggagtgtagggactggattgtgcagagaccctctttgcatctgtctgggccctcggcctattacaggagggacccctcacccttcctgcctgcaccagggtcctccaactggaggctgcttttagccctagggctagcgtgctctcttaagccagaagttttaggggcaagagatccctaatatgcatgaatgactctcacaagacaggcaggaagtctccaagagacttcctttacccctagggaaatgccatctgatctttgagataaggggctgggagcagtttgatttcatctccagagaaggaagccctcagttaaggggtcatcttgctcttttccccactccagggcctctctgccttatctctgtgccacctgtgaccccaggccttatacatgattgagaggattacccaaacagacctaattgacttattggaaatccaatcctttgattttttaattcacttcttttgtgctgctttatggagacaaaggagactcccctatactgcctgtgaagagcaagacagtctgcagccccgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattagttagctagggccgctgtaacaaagtaccccaaacggggtggcttaaacaacagatatttattatctcacttttctgggggctagaagtccaaggtcaacgtgtgccagagttggttccttctgagagagctgtgaggtaggatctgttccatgactctcttctcgtttctggtggtttgctggcaagctttggcattccttgccttggaggtctctgccttcatcttcacctgcattcttcccctgtgtatgtctggaagtccagagtatactttttataaagacaccagtcatattggatgtttaaaatgacctcatcctaactaattacatctgcaaggaccgtctttccaaataagatcacatcctgagggtactaggggttaggacttcaacttatgaattttgggggagagatagtcaacccataatgggcataagagaccgggagtggtatatgaaatatagtttgaattccacctcaagaccttgagcttatgacttctgtctagctctgtgtatcattcatacttcccactaatttttaacaaaatgactgggagagggagaaagtgaaacccagtggactgaggcttgagtgagcattacctcctgggcctgttgatttgcgtctccctggtgaccttcttctctgaccagcatccgtgggcttagggaaagcacggtggtggaaatgtgatcctggtgtgtgagatgcaaacttgatcttagcctttgctctccctggaaacttatcggtcaaaactttcactaaaggcagttttttgtctgtttgtttaggtttactggttatttattatttatagcatggttaaattgggtcaaatttttatgaattgtaagtagagaaacttttctaataagaggaaaggataagaaatcagacctttttgtaaagaaaattaccccacttaaagtcctggtttattttaggccgtttggcagtgagaagaagggattatttgtgtctgacagaggtctacaaggaaaaaggtttgggatcagaaaacacttccaaccagaatgacggttccctgccagtccttggtctttcttcctcccttccttctgtgcccacatggactaattatgtctggctttccctccctcttccttgtatatttcccttccatatcaagaccttcagaatgagggcaatgtggataatttcccagttttccagctgggcagctcaccaagaacaaacccagacatcaaggccagaccaaaaaaatcttcttgttttagacagaagactcctacatctgggggatttaatgcacccactgtccgctcagtgcatttcctgtgtccggagcttctctgcctgccggctctggtctcgtaagtttccatgccctgctgccaacttataataacagaggcggcaggcagcaggctgagaatgtcatagcctactccatacatgggcactgctttgcagactgaaacaaagcttgcagggtctcattgcaggcctctcagccttgacagtggttgtgcccagaccaccaggagcctggaattaaataccctcggatccagttctctactgttaatgttatcagcttcatcaagtacttcctctttgagtgatatctgtggagaaataaataaatcaagctcctccaagtcctgttcctgcctggatcctgagtccaaagtaaaatctgagttggattatccaaagcactatcaccctcctgcattgttcccaaggtctgggcaggaacggagagtgaaatctctccaggacattacatcagttcctcctttacccttggcatgaaagttcttcctctcctggtcctcccagacttcctaaggcctgccctgagtgcacacccacacactaagccttgaagcccaggacatcaaagaaagcctgcaggtaaccagattactgaccaacgcctgtgaccgttttgaaatttataagatgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccaggcatggtggcgggcacctgtagtcccagctactcaggaggctgaggcaggagaatggcgtgaacccgggaggtggagcttgcagtgagcagagatcacgccactgcactccagcctgggtgaaagagcgagactccgtctcaaaaaaaaaaaaaaaaaaatagtgtcaacataggtctcaaaaaaagactataaaatcataatagaaccatcatatcacttgaaaactagtagttcctcggtatcatcaaataatctgctagtgttcactttttgccaaccatctcataaatgttttttacagtttggatcagaatccaaacaacatctatacattgcagatggttaacgtatctcttaagtttttttcaacctataggttcccatctgcaaccttcttgtgtgtgtgtttgagcagtccctctcttcaggtttttttaaagaagtcagccataattagtatattcgtatatataatatattatatatattagcgtaggcttatatatactatgtaagtatatacttatatagtattagtatatactatatatcatatatactataatcatatatagtatatatggtgtgtgtgtatatatatactatatatcatactatgcatatatagtatattagtataatctccccctgtacatagtttctttttttcctctggttgctttcaagattttctctttatttttggttttcagcagtttgactatggtgtacctgggtgtggtttttattttacatatcttacttgagattcttggaccttcgaatttactgttgttgataatgttgttaccaaatttgaggacaatctagccattattttttaatttattctactctgtttttttctatattctccttcttggacaccaattacatgtgtgttagaccacgtgatattgttccacaggtcactgaggatttgttttgtttggatttcatttttactgatctgtcttcaaattttctaaccctttcttctctcatctccgttctgctattaagtccatctagtccggtctttcatttcagatattatacttttcagttatagaatctttattttgcctttttttttaattccatttcccttttggcagcctgtatgtgtcatcatttattacaaccatgattttcttttagggcttgaacttatttataatagctgctgtaaagtttttctgtttgtttgtgttaactccaacatctgcattatctcaggttctgtttcttttgatggcctttcctccttattatgagtcacatgtttgtatttcttctcatatctagaaaattgtgactggatgctgagcacattgagacactggattgtgttctattccactgaagagtattgacttttgttctaggaggcaatcaaattactggccagttactttgaatctgtagaggcatggtcttacgtttcattaggtccaatctgtttctattttgccttttgcccttagcagatccccttgtcctagggtttttactcctacattgtggccattctggggtaacaaacagcctgaagtgtttacagagcctttgaacttgatgagactcaaactctgaactctgtctccactgcagtagccagtagctgaggtttccgcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaaggagatgatcttttaatattgtgaacaatatttttgttcagtgatcatatgatagatgagatctagtagaactttcaaaaaagaaaaaagtccgcattttcttcttaaccctgtgtaaaacttaaaaccactatgtctgtctctgtttactgaccctatcaaattacggaattcactttatgtgttcttcatatatgtatattatcttaatggacaaaggtgatatgtttgacttgctttacttagaactgtggacaattctttgaccagaacaaggacagcaagcatgcacatccttttggtgagactgccctgggaacagatgtggccagagagagttcattgagttgggtgtggagccgtgtagaaatccccatttttatgggcagatttctgtccttctgcaccttagcagggacttctggagccaggtgtgtgccggtccattccccgacccagccctcagagctacttctcttgctgagctgtgtacacttctgatgttatcctcgctcacatgtcaccagcttgcaactttgagtgggatgagttagaggtgtccatccatcctgcttcttccttacttctgcctgtctctgagcactcaggagcaaagtgctcccaaaagttctttcaagttcagtaagattgtcattctgtaaattggggccactgtgcatgcttagagcaggttttggtgtgactttgtgtcatagtttctatattgcagtgacagatgttgtcatgagtacacaggttctagaatctgactggagtctggttctataatctcctaactggctgtgtgaccttgggtaagttatttaacttctttacgcctcagttttatcatctgtaaaataggggtactagtggtatctcttggttaggagtgtcatgagtgtcataaggttgggggtttttttcttttttcttctttttttttttttttttgagacaaagttttgctctgtcacccaggctggagtgcaatggtgtgatcttggctcgctgcaacctccacctcctgggttcaagcgattctcatgtctcagcctcccgagtaactgggattacaggcgggagccaccgcacccagccaggagtgctataagttttaaacagtgaaatccagcatctaagatatagttattactaataattattactaatattattaacattatcactaatactaataactcctagagttagagaatatgaaaattttagttgtgaaaatgtaagtcaatgaaagcatctagagagaaacctgtaagaacccttccacctctgaaagcgacgtagaagagttaaatgatggccaaaagatggggcatggaagtttggcttccttgtgcctacaggccacaggtaggtcattaacggaatgcttgtagacatccttaggttgtctggcaatagaaaaatagtttcaatatgcacaccttaaggccaggcgcggtggctcacgcctgtaatcccagcactttgggaggctgaggcaggcagagcacgaggtcaggagacccagaccatcctggctaacacggtgaaaccccatctctactaaaaataaaaaaaattagccgagcatggtggtgggcgcctgtagtcccagctactcgggaggctgaggccggagaatggcatgaacccgggaggcagagcttgcagtgagccgagatcgtgccactgcactccagcctgggcaacagagtgagactccatctcaaacagaaaaaaaaaaaaaatatgcacccttcaaattgttaagcagtgaaaaagacactgcattctggggagaaaggtcctttacacatacctacacgctcctccatttaccgcctgtagagccgcagggagtttcctgtcctgccaactcactggggtctgtgattgtctttccctctgctccacagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcaggtgagtgagttcccctctcgccgctccagcatcatggggacctgacaaagtcccactctcccctgtgatctttgcagccagcctcgcaccattcccaattaggcgccctccaaggctctctgagggcaattggaggcttctgcttggatgaggctaaatccctaatggcttggttaatgagccgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtctcagattcaggcctgtaattccatcctgtgagcggtaacgccatgcagccttcaccttaggagcgggtaggagaggaaaacaggattatggtattggaggcaggtgttgctgggccatttggacagaggaaaccactcccagattctctttcatttattataagaagcccaaatttgcttacttaagggaagaaaccagtggaaaccagtgggaaaaatatctacacattgtctgtttcctaggatgctcataatttacatgaactcattcttcagaagcttaatcctctaaccatgtgacaaggttagctcttttcgtagagcatttctccattagatatttgttgagcacctgctgtgtacaaataaatgcattaggagtagggatacagagctagtttaacatgcaatatctttttccccaaggaatttagaatatagtgggagagacaaaggtgaaaaccactaagatataaggcagaatgaagtcagccccatttcccattcattttatgtaccagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggtgagagctctagctgaccatcaaggtgctgccatgctgatggcagtggaagaacaggctcctacaagcctactttacttctgccttgaggtactgtcccttttttttttttttttttccacactctgttgcccaggctggagtgcagtgacggaatctcggctcactgcaagctccgcctcccgggttcacgtcattctcctgcctcagcctcctgagtagctgcgactacaggcgcccgccaccatgcccggctaatttttttcatatttttagtagagacggggtttcaccatgttagccaggatggtcttgatctcctgacctcgcgatccgcctgcgtcggcctcctaaagtgctaggattacaggcgtgagccaccgcgcctggccggtactgtcccttttttatttaaatcatgtatttctagatttttctctggccccaagtgcaccaccagtgttgtctcagtttcactgttataaatcatttacatcagggatgttgaatccagaaaataaaatggcaaacaaaaatgacttatatgttttaaaaactatgaaaaaggaaatgatatatgtttgggattccattcaaaacgatcctgcagagttagggggtgagatgtgggtggggcctacataaaacaaggctagccatcaccagctagtggctatatgtctgggtgatagatgcatgggggttaatattattgatctctctgcttttacctgtacattagattgttttaatcagaaaatgaaaaaataaaactggggaaaaaaagaatagtagataaagaagcaaagagcttgggcaaaacatgtgaatttccccaaataattggagaaggaggatgaggtcagtgtattgctgtgaattctataaatgacccatctcgtgctttccaggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaaggtcagataggggccccatgaccgaggtgtgcaggacaacccttgctgcccgtggctgctgtccatagtgctgccctcgtgggcctggcttgcttcccaagatctctcctgtctacctcccaggtgacactgccttcaccacttcttgggaatctaccataagcccatgaatcaagaaagacacatggtttagacttgaggagttatttttcccttatttagtaggtttgtaaatttcaaaatattagtctcttaaaattatattactttttttttttttttttttttgagacagagtctctgtcacccaggctggagttcagtgatgcaatctcggctcattgcaacctctgcgtcctaggttcaagtgattctcgtgcctcagcctcctgagtagcagggattacaggcacacgccaccatgcctggcgaatttttttgtatttttagtaaagacggggtttcaccgtgttggccaggctggtcttgaactcctgacctcaagtgatctgcctgccttggcctcctaaattgctgggattacaggcatgaaccactgcacccagcctatactactatttttttcatctcattccccaatatcagtgtttgatgatggatgcggcctcatcggttaggaagcttggtggaatactgcacccaccaaatgatgagcctgggtgtctatgggtgcccgctctctcaagggcacacagaaataggcaatatgtgcttttcttgatggctctaggaagtcaagaatattcatgtaaaataaccctggggcctagatcttttgggggaatgcgttaactccttcagtataacacaatgtcctaaaactaattaccagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcaggatttcgagaccagcctggccaacatggtgaaaccccatctctatcaaaaaatacaaaaattcgtcgggcatggtggtgcacacctgtagtcccagctaccgaggaggctgaggtgggagaatcgcttgaacctggaaggtggaggttgtaatgagccaagattatgccactgcactccagcctgggcaacagagtgatactctgtctcaaaaaaaaaaaaaatgtgtgtgtatatatatatgtgtgtatatatatacacacacatatatgtatatatatatgcgtatgtatatatacacacacacgtgtatgtgcgtgtgtacacacatatgtgtatgtgcgtgtgtacacacatatatgtgtatgtgcgtgtgtacacacatatatgtgtatgtgcgtgtgtacacatatatgtgtgtatacacatatatgtgtatgtgcgtgtgtacacacatatgtgtatgtgtgtgtgtatatacacatatgtgtgtatatgtatatatgtgtgtatatatgtatatgtgtgtatatatgtatatatgtatatgtgtatatatatgtgtatatatatatgaaatttttcataaattcttttcattatctattatcactgaaattccatcataccattaagatacatgcagaattgttctcactcataggtgggaattgaacaatgagaacacatggacacaggaaggggaacatcacacaccgggtcctgttatggggtcgggggaggggggagggatagcattaggagatatacctaatgtaaatgacgagttaatgggtgcagcacaccaacatggcacatgtatacatatgtaacaaacctgcacattgtgcacatgtaccctaaaacttaaagtataattaaaaaaaaaagatacatgcaaatttatgtctgttaggtatttaccatatggaaaaactaaaataatcaagaaaggaaattcagtaggtggttgacagtttaaatacaaatcacaaatgacatctttttaaatataacaagtagcttatttttaaaggtgtcacttactttgcaaaggataaggagaactgttattaagaatttaccaggttggaatggctagtgtttatgggagagagtttagcacaagacggagtgagacaagattgctggggtcttattttgaatccagcagccaacgctgtatggaatagtgaaaaagttgcctctttctgtgcttgttttctacttggtatctttaagaatgggctatttaggagcaaggagcctagcagaaagcatctgtcaatcttctaaaactttacctacaaaagttttactggcttgtgtcccaccagtgtgtttcaaagccagaaagtatattggccacaagcacctgtaggtggctgaggtgtgactgtagtcatccgtgagtcatgttttcagtatgtattgaaattccttatttggacttgatttcaaaggtagaagggccttttacaggtgaaggaactgagattgagacacatcaagagtctagcctcgagcttctgttcagtgtttttcccaaaattattgtttccttctggtctgggactctagagcaaagattgaaaactgtggcccaaagtgtgagccaaatccagccaccatgcgttttttttaaatcaagttttcctggaaaacagccaaacccatttatttggtattgcctatgtctgcttccatgctgcagtggcagagttgagtagttacaacagagattgcatggccagcaacacctaaaacatttattagttggccctttacagaaaacgtttgatgctctctgccttgcaacattgtgtacgtggtggtcagtgtgcttggaatcataggtgcaatgtaggatgcagacttagaaaacagtgcccttgctcccaaggaattatttgcactttagatgacaaggcatgtttgagacatgtgaaaggaacaataacaagttatgtaagagaggagacaggttctggactgcaggctatattttcagaccaaccagaatagttacgataatatcattaacataaataaaatactaagtatttagctacgtaaaagaaacgatttatttgcactttggattatacagttcttcattcattgattcaaaaattattgccagtctgctcatgtgccaggcattgttctagatgatagggcactgcatctctaaatgccaaatttcgtatccttgctggtggaaggcaatgtcctcttgctttatgccatgacacaaactaagctcctgctttaactatagacagctaaatcttaaacgaacacttttcagtcagtttagttttctcttaaagtactttaattccgttaaaacctgagccaccagatttcctgtctgcctgtctcttccttggccttaatccaaaactctgctgaggaagaagattcgttggtacactgacaattgttttataatccattcatttcataacccctcatttgctacccaaaagtggggacctaaatctgtacagatttacgtgttcaaaggccatggcctacccaaatagagaatatctcctttcttgtgtttctctcacaacttttgctgaagtctctccatctttgtgaacatgaacttctcgatttgtgaggctatcgctggtcagttgggtcattaatcctacagcaggcaagacacagaatttcctctcagctcaagatctcttcactcccaaccctcttagaacacacttcgcagcaatccttggaatctttaaaggtagccttttgtgactttaaaaaatacttttactatctctcaaggttacatccttaacagaaacaaaaagattctaatcagcgagacatcaagtctcttgcattgcttatttgtcacccaactaaaacaatgtactttcttgatttggttttattgactggatgaattatatatatacaaagattcaattagggaagcctctgaagtaagatgaagaaaaaagtatgaaactccagagaaagcagtttgaggcttatcctcaggggcttcaaggactgggagaagtcactgtattctggcatcttgcttctgtctccacttcctcccacagtgtttaatgctgctgtgaatttgtttcaaaggaagcctatagacttttttttttttttttaattttgtacatgagcctcaggagcagccttgacagctaaaagacctcgtaaaagagaagtgtgaagggattgcatgaaagtgctgggggcaagtctcagccctcggcctttgttggaaggtgtggggtgtgcagacacatgtgcaccttcgcacacatgcatctgtgcataaatatctgtgtttgcaggaaagaaaagatagggttgtgggatgtccccagaagccacagggattccagtgttttagtaccaggtgaaagagccgcttcctcccacactatctcagggagatgcccttctgtagacctctgtagcccagtaccctcaagagctcctggagacagatggccccgaacagtcctagggaagcagtgtgggcctgtggcaaaagcttggactgcgaagtcagcatgattggaatccggttcttgactcccaagcaggtgcataatgtccctgagcccttctttccttatctgtaatattgagaatagtaatacccatttctgggcccttttgactgttaatgagacaacatgtgaatgcatggcacaagaaagttaattgctacgtgtcactgtccccccctgcctcactgctgagctgccatcctgcccatctgagagggactgtgtgggagctgtgggtacagccagcacaactgcctgcagagccacgcagggcactgacagggaaggcctgtgtggggtgcccttcaaggccacctccgttttcttatttccttggagatttacttttgtgctcctgcttcccctccctgaagctttgcctgctgtccatatttggaggggatgaataagatgagcactggggaggggaggagccatcactccagcaggaatattcccagcggctgagtcactgcatttgattttcagtgtgaacaactgagaaatcaaagagccctaaaagaggaggaagtttcaggacaatgtttttaaaagataaaaaaacatcaacagcatggtgtctgagtggaaaataatagaaggggcttgaggagactggaaattccagtttgtgtaagggcgcacagtgctgtaatacagagtcctacctccctgcagtccctggatgtgaattcccaggctgcacccacacctgagcaaagcggaggctgggccttattaggttctgactgcgggctggatctcagctgcaggctgtgagtttcggataccggtgtttccaagccttctccacaccttatgtaatcacaggtgaaaaggtccagcctcatttgcagctgtggttcttctgccccaggaagccaggaagcgtagatttttgtattatttgcctccacttctccctcccccagcgtgccaccgtgcacatatgttttctgttttcctaagccacggcaaagcacaagcaattgcccattgtaaacacacctctgcgtatcaacacacacctggctgcactggattgaccaactttctgcttctaggtaatggctgatctagaatagaggaggaggaggggaaaaaaaaaaaaaacaagcagcagatggccccctgaatgttgtaaaccgtgtttctctaagcagggtttctcaacactctcgatatttgggccaaataataatttgtggggttgcttactatattgtaagagattcagcagcatccctggcctctacccactagatgctaggagcaccctgcaccccagtgtgacaaccagaaatgcctccagatattgccacatgcccccagttcagaaccatatttgtaaagcttagtagcaactttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaaaaaaggaaaaaaaatctattgtgtggtcaggcagttatttttatcatctaggcataatttttaccaaagaaacaaaacaatcaataatgttataaaagccacttatactctgagcttgaaacaactgctttatgccacaaaattcctattgctgtctccgttagtgactaattcaatatgtcctgaatgtcaacgtatttttattactcagctaaagttggctttgctggattaaatgtcatttaaaatgatcaattggcagcttgtttggggttgttttcacatttatgaaaggaaaagtttgccggatacaaatgttcttgaagctgatagggaaacggtgttctctggtaagccctgcccttccttttgccatctgataagtagataacattctaggtcctagtttgatgcctccgaaaaaccaacatggcagcccagtgcaggttaagcccttacattggagaaatggtctggttcacgtttcactgttttatgagaagtagaatgtaccattacagtaaaagagaagcaacagaaacatgcagtgaaaacgcccatgcttgtggttagagaactgtccgctttctttttgctctacagtaggcttctgagtggagtgccttccgcctagagtcaagagggctgccatgatgtcacccaccttcatatgggcaaaatgtctttatatgaaactgtaaaagacaaccaggtcgtttcttaattgctgaaatttattaaaatgaacacactagaaaatcacattcccaatccagaggaatccaatggcgtcgtcagcctatttgcaatggaaatgattgtaaacctatagggagacataggaggggctgcacacaaactactttcgttcgtcctgatttactggcttcttttccccctagagatacagtctcactctgtcactctatcgcccaggctgagtgcagtgggttgatcatggctcactgcagccccaaacccctgggctcaagcaattctcccacctcagcctcccaactagctgggattacaggcatgcaccaccacgcctggataatttttaaattttttgtagagatgaggtctcgttatgttgcctgggctggtcttgaactcccggactttcaagcaagtctactgcccctgcctcccaaaacaaacattgggattataattataagccaccacacccaaccctaatttacaggcactgtatgtgataatatgtgattttgtcagatgttttccagttggaagagattatggaaaattaaaatgtgtctgccatttgatagtaggacaaatactgaaatattaagccacagctgagttctggccttagtccttttggggctgctctgacaaactgccgtagactgggtagttggtacgcaatagatacggattgctccacagttctgggggctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaagggaaaaagacactttgccactttttactgctttgcttagaaactagaatcatcctccttcaaatgcctgtaaaacgagctagattattctcagtctgcagtaggacactgatttctcaaggtacttaagatgcttgggttgctcatcttctccacacccccacctcagcccatcccctggcaatacagaatgcagccatggcaagacggggtgggcaatagaagtggctggacagcttctgttgttagaatggggttcaaagtccaggactatggtgttgttgttttaagaaggaggccacttgtccttttccaaaacacaatgagtgacacaccacattaatgtttaaacacagataatacagaagaaaggattccataagggatactaaagatttagggctgctgtacatttaatggtagttccttgaaagattaagcttctggaaaatgccacagttttctgccagtgtcttctgctattcaaagagaacgctggagttcagaaaagatacactgagcaggtgtactttgttctggaaagtcctaagattttataaacatacacccattaacgagtttctctgagactagaaattgcattgggaagtgtgtcatagcatgggttttggggtcatgcacagccaagaatcctgtgtgtcattcataagctgtgtcctcctgagtaaatcatcaaaccctctcagccccagcttcctgatctataaaataggaatagcaacagcacctgcctcataaggcggcgtaagggtcagatgtaaccaggcttgtcgaagccacagcacagtacctacaaatagcacccactaaataccgttgttatttttattactttctcttccctcccattatcactaatataataatcctgtaaagtaagtgctgttattcccacttcataagtgaggcaacagaacctcaggaagattaagaagcgtgtccagggtggcccaactgaattccccttgtaaatatacccccagagaagggtgtatgtttctctgcaatgcggatgtgttggctgtaatatattccaagtctcaactggacactcccctttcaaatgtgccaggcctaggccttgcccaaagtaaaaaagaaagaacattgtagtgcaggagtccagagtgcaaatccttgtgacctcaggcaagttatttcaacctctctgaggatcagaaataatacaggtaaagtgccgagttcatacttgtaattcagtagttgatcttccatcaccagccattctgacaagtgcctataaaaagtgggcatttccagaaccatgcagtgaacacctggaaattggtgctgctcctcatctggaggccagttaacctttaactcaacctagaaggcacacatctgtccccagctgcctctccaggttctgctggagggcaaccacacaccttcacagcacacatccagaaagtcatagaacaaggggaaggtgtacatcatgtcttcttctttttttttttttttttttttttttttttttttttgagactgagtctcactttgtcaccgaggctggagggcagtggtgcgatctcgacttactgcaacttccacctcctgggttcaggcgattctcctgcctcagtgtcctgagtagctgggattacaggcacacgccaccatgcctggctaagtttttgtatttttagtagagacggggtttcgccacgttggtcaggctggtctcaaactcctggcctcaagtgatccacctgcctcagcttcccaaagtgctgggattacaggcgtgagccaccacgcccggccatgtcttctcttttaatttactagcccacagccaaaaaccaaggcccaacaccatgcctagtccatattaaatcacctaacacttaataaaatatccattgcctgactaaatgttcaaacatcagttctgcaagtggagaaagtgacttttgcactgggttcctttctgccatgatccactatatcaaaacattttttaaagacctccaaaatgtgatagaatgagaatatctgtatctctttttgaaaccatgctagccacagttcccacagtcagagtcaccaagccacatagtttttcttttcccaccatttttcactcctcactcctttttgctgtgttttagcctaccccagccttctcatctttatccatccatctcccaccaacaccaggataaccttttcactccactattttttaccacacagctctctctgtaaccatcaggaccctctttccacccttttttccttccagcctgcatttaacacacattcagagcccattgattcagttagaacttgcctcccgtctttcacatgggttctgcccaggtttaagtttgggtcacgaccgtggacttctgggtcactgtatcatcatctgtggagggaggctgtcgcctggatcatctctgaggcctccggtgggtcaaaggtcacacaacaggacctccctccatctttctgggcctccgtttcttcccggtaaaacaaggaagttagttagacaatcagtcaacccaagctaggcagaagcagttgctggattcttttttgattcttctggttagtgcctcaacaagaaacattttcaacagtgttttcttgcccttttcctctgtagactgtagactgctttgggattacgtctatcagttgctttctgacagccggtacgaaaacttcatccgatgggaggacaaagaatccaaaatattccggatagtggatcccaacggactggctcgactgtggggaaaccataaggtaaaagggcagcagatatctgctccataaactagtgccaaaatgaagtccttatccctggattggaggataatcgtctgtcttctgctttttacgtctgcccatacttatttagtttattccttgctgggcaagcaattaggcagttgcaaagggaaggaaataattaaagatgcatcttgccatttgttcctgagaccaggtgcccattaactcacatatcctggtttgctgggctgcatcatgagtgactcttgtttccactccccttgacctgatcccgccacctccactgttgttaggaactgggtaaaagggaagtacagcaagactctctgactcacaggggacctttgggaagtgccactacttttctgctcagttagaaactcccatgttccccaaagcccatttctttatagaaaatacttagattctgactgtaaaacatcccctttataagcaagcgatgcaagaagtttgccccacaatttcccaaactgggaggagggaatggaattgaataaagtcttttgcagtaaggaagactgctcaagtgcgcagttgtaaaaagcgggtaaccgtgatccaggccagtcgataggtggacctgaagcaaagcctgatgttggcatggtggcacaaccccaatccgctgagtgagtgaaaaggcagggaggcccagccaggtgtgcccagacctgcagccttctaagaaggcagtgggtaatgcagaccatgaccaaatatggcaaggccccactgacagacacttccatgtgtgagtcactgagaaaaatccctctgctactcccactgtaccattgcctcgggcccagaaccactgtattcttgcttccacaacaggaatttaaacaaaagaattgtcttccttaaaatgacagaccagaaacacaagtttgagaaaaggtcattgcaacaaaaaaaaagaaatgctgtgtgggtcagaaggtgaagggtgacccagagatagggggaacctgcaggaaattcctcaggcggagcagagagcggtcttgggaaaaggaaataagcgaggctgctatgggatctgctttattagctagggctccaggacttcggacaaagggtgattcaccttaggagtaaaccttggtgacagtgaatataaaaagctaaagggtggggacagatgtgcctggaaggcagccgattagcaggtagcttcccaaactggcagggccacaggcagcagctgaagagcttttattttaatagctcccgcagtgccttttctgaggttcatttcattgtgtctttgtgctttttttctcccttcctcctttgaacaaacagaacagaacaaacatgacctatgagaaaatgtccagagccctgcgccactactacaaactaaacattatcaggaaggagccaggacaaaggcttttgttcaggtagcacttcctttttctcctttccttcttttgggaggatgctgttttctttaaataacggggagtggggggagactgttaagatctctacctgcctatcggatacccaaagccaatcattgctacaaactggataccaggtactggtttgttaggatttaaggaaaatatttttttaacttatgtctgtcctgtaataaagccaaaactaaatgaacagaatctgactcacctttaaaataacgcagtgaccaaataatattatgtggcattaaagtccggtgtagttaaaagcacaaagtcaatggcaaaacaaggaattaaacctagacttccaggttaccatcgctgtaaggcaactttctgaaccagtatttgtcaaaatgcaggtaatgacccacagtgagtcatgaaatagattgaatgggtccatcagagctttttttttttaatgaaataaggataggataggatagagttgaaaatgccagactgcatgacatgtagcaagaatgacagttgattcatgaaaatgttgttccaggtgtgtatgtacgtgatgagtcatgatgtaaaatgtatttcttataatgcatcgtagtcagaataagtctacaagctgctgcactagaatttttctttccagaattcctcatagataatgagttccaaccaagttagcctgccaccacatagattgtaattccaagtactatgcaagagaggagaaagaactggaagaagaaggagggatctgaaggaccaatcaggagatgtagaagtagacctctggtgctggtggtagtcattagcggggccaactgcaggttggtagaagtgagatcaacaaacacaaccttgggtgatgagttttggcaggtgggccagaagagagtggcagatggggctagagatgtagattgtgaattatctatatacaggtaggaagtgataccatgtatgaacagatgagctcactgatatgattaatttattggaaagagcagagaatctggtctttagcattgggaaggaatggtaacttaggaatagtaaaagcaattaagatcttcaaaagaaacgggaaaggctcttcaggaaagggaaacagaatagaaggaataaaaaaagaaccctccattctctggctctaccgtatggcttttcttcatccttcaacctaaacgcagtccttggctccctttcttcccactctatacctttttcgtggatgaactgatcccgacacacaacttcatttatcacctcagtggttaggctcttaaatctctatatccagctctaaaatctccctgaaattccaaatttgaatgtccaagagtttcctgtaggctgtgtccccttaaatatcacatttaagtatttcagacatgacatcttcaaaacagacacttgtctcggattagaaattccacccagaggccgggcatgatggctcacacctgtaatcccagcactttgggaggctgaggtgggcagatcacgaggtcaagagatcgagaccatcctggccaacatggtgaaaccccatctctactaaaagtacaaaaattagctgagcgtagtggcatgcacctgtagtcccagctactcgggaggctgaggcaggagaatcacttgaacccgggaggcagaggttgcagtgagctgagatcgcgccactgcactccagcctggtgacagagcgagactccatctcaagaaaaaaaaaaaaaaaagaaaagaaattccacccagaattattgaattctttactcatcaggggcatcactgctgtttgaagcagccaactttgaaactacagttccctttgactcctcctgtatcccagtcattgtgctagatggaccattggctcttcagcaccattcccactctattctgtgttgcaggggctagaagcctgggaactacatttcccagaagggactgttgccagaagttcccaggttggagtctttcagtgacaagcagtttcatgagatctgggagactagaaaaaagtaaaggcttccctggcagtggaagctgatgtctggacttcatgattcacatcgggattcactcaacaacgtctttctgtctctagtccactctgctgcctcctgaaaccataatacaaactgccagctgccctacaacactaatacagttccctatgccagaaatgtatatgactaacttttgcctttttaatacctacaccctcaaggctcaacctcaagtctgttgccctgaatgaggccttcttcagctgctccaacacacatagctgtcgtcttccatcatcacctgggtttcctggagcccttaactacactacaatttgctttttcttttcttttcttttcttttttttttttttttagacagagccttgttctgtcacccaggctacagtgcagtggcacaatctcgactcactggaacctccacctcctgaatttaagcaattctcataattatcatgccgtagctaatagtagctggaattacaggtgcctgccaccacacctgactaatttttgtatttttagtggagacagggtttcgccatgttggccactcttgtctcaaactcctggcttcaagtgatctgcccaccttggcctcccaaagtgcttgaattacagatgtgagccactgtgcctggccaacttgtttgtttttctagagacagggtctcactctgttgcccaggctagagtgcagtggtgtggtcatagctcactgaagcctcaaactctgggctcaagccatcctcctgcctcagcctccggagtagctagagcgactacaggatttatattttgaatacaggttgagtatccctcatctggaatgcttgggaccagaagtgtttccagtgtttggattagggatgctcagcctgtagttttatgtgtcaagtccttctccccgacaactagattataagctcctagaaggtagaggattctattttttatcattctatattaaacctttcagttaatgcttattgacagcctggtgtggaatatcagaagcttaatatgggaaagtcgtcaaaagaagaaaggggtggtttggggggccaagcataggacatctgtggagttggcttagaggggctctttattgacttcggatgtggagggagaaattttagttaggggataaaagaggagaaaaactgcagatgctacagatcatactgctggagaagtttgccagtaatgagcaggaaaagcagtagtagccagaagattgataggcttccaataaaagattttcagtaagagaaaggaatagtgctattagtgagggagagattagtccattttgaggaaatgaatgttagaagccagacttgccacaaaatgaaggtttcttggtataagacctagtatgtaatcaagtgaggtgttgaattgtagatactctttacaagatgtttgagtgttgaagaagatggaggtttaagtgttgaaatcatggactagtgccattaagcagctctttgatgaggagacagaacacaaagaatgagtaggactcaactcgtgagaagagtcaggagggctccagataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagagaaaggtgtgcaggcacagaaggggactggaacgggtgctcctacagtgtaggtggaacatctgcaaccaggctgccttcctgagccatgtaaattatggtcaaaacatgtcactgatgtcacttccagtttaacccattgaacaggaagatgaggcttgctgtacaccccagttgcaaaggtagacagactaaagagggttcattgctggcattttgggtgaatcagtgataacattgtaaaagatttttttttttttttttttgcccttccaattttccagaagctccactaagttgtcctattgtcagcatttttcacttaacatttaactatatcctttgaaatttaagtaagttttgaataccatttcctgggctcacagtctggaatggaagtggatatacagctctcatgagtctgtaaaatctaattctgtaaaagaaagaacatatatacatggtctggaccaaggctttctcgtgtggtcatgcattaatgcaccacgtgatcccaaagggtgctcactacgtcacagacagcctagacttttttttttttttccaataattaggatttcactttgtcacccaagttagagtgcagtagcatgatcatagctgactgcagccttaacctcctgagcttaagggattctcccacctcagcctcccaagtagctaggactacaggtgcacaccaccgtacccagatttttttttttttggtagaggtggggtctcgctatgttgcccaagctggtctcaaactcctaggttcaagttatcttcccaacttggcctcccaaagcactaggattatatgcatgagctaccatgcctggccctagtctttttaaataagcattttaccactttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataa

SEQ ID NO: 295 - DNA, 109819 bp, Homo sapiens
  source 1..109819: mol_type = genomic DNA
cccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcaggtcggtgtcctaacctcccaccctcctccagcccgccctgtccccttgcagagcgggctgcctcccagactagggtcagggactgcggacgggaacgcacagaaaaagccttcaccgtgctagtaggaaaaaaaaaaagtcaccatctgtcctggcctcgattcccctgatggaagtgcgtgtgactgcaagctaagccagcgtgggcgccagtgcccttatttattttcaaaacagccgtttctcccagctacagcctcctgtttaaaagacgagctaattaatttttggctctagtgctcatggctgatgtagtgagatttggctcacacagtggatggattataggacctctaagaacagtctgtttcttaaaaacgggtgttagaggttccttttctgaagggatatgtgataggtgtccacttgctttgaaccctttagtgcaaaggtctccagaaacagctttttcttctcagaaggtgtcttggtccgttttctaatcttgtagaggttggccagacagcaggcactggtgttttccattgttgttctctgtccatgatttttagacttctctaagcgtttgagacaagaatgggaggattattgtgtttgcaatacagtgagtgttcaataaatagataaagcagctgatgtttaattgaggaccatttgctgctttttttgttacccacacgctaggacagctgggagtgctttggttaagctccggggttgctaacgcaaattggttaaatctggggcctaaaaagagtcgccgattttagaagttctctgttcttgataggagctgtaattcagaaataggcaagctaatagatctaagggtgtttcactttaaggtgtgactttcaagactagttcagacctacattctggggactggattggggcagctttgaatggtgagcagcatctactagctttgctacgtttttctatttccttggaagggccagagtgtcatatctgttataagaaatataataattgccacctttgacattcttgcctctatggcagggcagaaacatattttagggggaagcggtgtggcatctttttaatttgttttcttgcccatgaaccaacagcattcgagcatttccgatgttagaatttgcctattcccctgtgcccggtactttacatacatttacatataatttttgcagtaatcccattttacagataaagtagtagaggttagctagagtgttttgaagtcccctttcctctggtatctggggaaggaggaatcacaatttatagcaggaaagatttctggcatggcttttgtaaaatgttaggtaaattaccaaaacaggtaaataaatatttcttgaaaagaaataaaagcagcagagatttttctagaagagtgaatgccaagcctccggagacgagcttctaggaggcagaacagttctatggcatccctggattaacctttgagatatgactataatgagcctgggaatattaccttctagagcataaaacactttaaagattcattcttgtcccagtctggaagatatttgggggagaggatgatttcttggtctagggagtcctttataatttgaatcacttccctccaaatggattactttctcccaaggaacctgaattgatctccctctttgtcctccaaatttctgatttttgcctcagcctagaatggacttactggctatttttgccctggactaatgctataattttaagagtgagggggctgtagtcctagctactcaggcccaggtgggaggattgctggagcccaggagtttaaatccagcctgggcgatgtagtgagacttgactctttttttttttttttttttgagacagtctcactgtcacctaggctggagtgctgtggcatgatcttggctcactgcaacctccgcctcccggattcaagcaattttcctgcctcagcctcccaagtagctgggattacagggacatgccaccacgcctggataatttttgtatttttagtagagatagggtttcaccatgttggccaggctgatctcgaactcctgacctcaagtgatccacctggcttggcctcccaaagtgctgggattacaggcgtgagccaccgtgcccagccgccttgacttaaaaaaaaaaaaaaaagagtgaggaggctgaagcctcgggaataggccagtcattcgggggttgagaacaggtttttttcctggacttactaaacatagctggcttgatgtggtagggtggatagacagctttgcaactccagtgtcgcagagatgggccttgtgtaccaataacttgtagatgtctaattcctttcctaactgtctagcactgctgactttgggcaagtcacagttaaattttgtaccctttatttctcattttagaaatagggagatatatatatatatctcaagatagcaggagaattaaagagaaagtaaaaacaatctgcctatacttttgtgtgctgaaaaagaaaatatttagttatgaaagaagttcattcatgttatataatcctgtaatgggctgggcgtgatggctcacacccgtaattctagcactttgggaggccgaggtgggtggatcacgaggtcaggagttcgagaccagcctggccaatatggtgaaaccccatctctactaaaaatacaaaaattagccagatgtggtggtgcatgcctgttgtcctagctactcaggaagctgaggcaagagaattacttgaacccaggaggcggaggttgcagtgagccgagattgcaccactgtactccaacctggcgacagagcgaggctctgcctcaaaataaaataaaatcctgtaatgtctgagggtttttgttgttgttgttgttttgttttttgagactcttgctgtcttacccatgcagtggtgtgatcatggctcactgtggtcttgacctcctgggctcaagtgatcctcccatctcagcttcctgagtagctgggactacagtgtgcaccaccacatctgactaattaaaagaaattttttttttttttttttttttttttagagatagggtctcactatgttgcccaggttggtcttgaactcctggactctggtgatcctcccactcagcctttcaaagtgctgagattacaggcatgagccaccacacccagcctgaggtggcgtttttgtttgtttgtttttgagacagagtctcactctgttgcccaggctcaagtgcagtggcacgatcttggcacaccgcaacctccgcctctcgggctcaagtgattctcctgcctcagcctcctgagtagctgggattacaggcacccgccaccatgccccgctaatttttgtgtttttagtagagacagggtttcgccatgttggccaggctggtcttgaactgctgacctcaggtgatctgcccacctcggcttcccaaagtgctaagattacatgcatgagccaccgtgcctggctccagcctgagcttttaaaaatactatagaaaacagtttctataattcatccctgccaccccaaccccaactgcaagatagctacattttataaaattattctttttaatcactacaccaaaaactgctttggtgaggcagagatgcctaatatgcatctcctaagcagtgtaactttattttcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaaggtaaaggattgcgttttgttttatctgaacttgctggagacgtttgtgtagccctactactttccctctacttatccatgtatcttgctctctcatctcctttaggtctttgcttaaatggcatcttctcagtgaagcctttcttgatttccttaattaaaactgcagcccctttgcctacctgtttttctctatagcacttaattatcattgacctattgcaaatatctttatctgtctatatttctctgctagaatgtgagctccatgatggcaggtattttctcttttgctcactgttgaattcccagcacgtgaaatataatctggtataagatagggactaagtgaatgaatgaggttggaaatggcccttccctgttatattcccatggaaagattttcattcttatttgtgatctggacagtgggtggactagttcagatccatagagaaaaatctccatcactactgatacactcgtaattaatcctggcggcagttttatatgagagtgtgtgtttgagaagagagattacccacccaattagcatatactgtggtagttaccttttgaacgaaggccacaactttattatttttgtatctctattaagtagtggagattattttatattaactggtgtttctgctgtaagagtccttcagttctctcctccctcacccccaccaaagattaggaaataatgaacataaggccctggtttacttaacttggtataatacagtgtaaaacatcttacatttacatagctatttgaattaaaatgcccctcctcatacacatatcatccctttaattcttacatcattaaatgtgtttcaatgattggggtaagataagcttcttataagccttttataaggcagctggcatacacagaggttgtacttgaaccttcttcattgatgtcaaatcctatattacactgttccacactatttagaaaacaaaaacaaatggtgctttatagatgatccatatattgtcttattcttaccagtgcttcatctgtttcataaataaggaaatacaagctttcagtttcttttttattattatttaagttttagtgtacatgtgcacaacatgcaggtttgttacatatgtatacatatgctatgttggtgtgctgcacccattaactcgtcattcacattaggtatatctcctaatcaatttcttccctacaggcctgagagttagactttggtaaacattctggctcttatgtaaaacaacacattatatcatgttactcatcttttttttttttttttttttttttttagagttttgctctgtcacccaggctggagtgcaatggcttgatcttggcttactgcaacctccacctcccaggttcaagtgattctcctgcctcagcctcctgaagtagctgtgattacagatgcctgccaccacgccaagctaaatgtttttattattattatttttagttgagatggggtttcaccatgttggccaggctggtctcgaactcctgacctcaggtgatccacccacctcggcctcccaaagtgctgggattacaggcgtgaggcaccttgcatggcctactcatcttcttagttttcatgattttgaggaataatgtgattctctaaagaagttaacaatagtagggcatggtggctcacacctgtaattccagcactttgggtggctgaggcaggaggatcacttgagtccaacagttcaagaccagcctgggcaacacaatgagactctgtctcaacagataatacaaaaaattagccaggcatggtggcacatacctgtcgtcccagctagttgggaagctgttgtagaaggatcgcttgagcccaggaggtcaagggtgcagtgagcagtagtcatgtcagtacacttcagcctaggtgacagagtgagatcctgcctcaaaagaaaaaaaaaaaaagccggccaggcgctgcggctcatgcctataatcccagcactttgggaggccgaggtgggtggatcacctgaggttaggagatcaataccagcctggccaacatggtgaaaccccatttctactaaaaatacaaaaaattaggccgggcgcagtggcttacgcctgtaaaacagcactttgggaggccaaggcgggtggatcatgaggtcaggagatcgagaccatcctggctaacacggtgaaaccctgtctctactgaaagtacaaaaaaaattagccgggtgtggtggcgggtgcctgtagtcccagctacttgggagggtgaggtaggagaatggcatgaacctgggaggcagagcttgcattgagccaagattgtgccactgcactccagcctgggtgacagagcaagactccatctcaaaaaaaaaaaattagctgggtgtggtggtgtgcacctgtaaacccagctactcaggaggctgaggcaggagaattgctagaaccaggagatggaggttgcagtgagctgagactaccacttcattccagcttgggcaacaacagtgaaactccatctcagaaaaaaaaaaaatatctgcatataactttcaacttagccaaaacttaactactaatagccttctgtttactagaggccttactgatagcataaacagttgattaacacatcttttgtgttatatgttattatatactatattattacaataaagtaaactagagaaaagaaaatgtattaagaaaattataaggaaggccaggcacagtggctcatgcctgtaatcctagtactttgggaggccgaggaggatggatcacttcaggtcaggaattcgagatcagcctggccaccatggtgacaccccatctctactaaaaatacaaaaattagttgggtgtggtggcgtgcagctgtagtcccagctacttgggaggctgaggcacaagaatcgcttgaacccgggaggcagaggttgcagtgagccaagatcatgccactgcactccagcctgggtgacagagtgagacttggtctcaaagaaaaatataaggaagagaaagtatattaactattcattaagtggaagtagatcatcagaaagatcttcatcattgtcttcacgttgagtaggccgagaaggaggaaaaggaggggttagttttgctgtcttaggggtggcagaggcagaagaaaatctacgtataagtggacccacgtggttcagacccatgttgttgttcaagggtcagctgtaattcgttttatgattaatcactagtaggggaaatatctagaagacttggtgttaagggaagctaacctcagatttgaagtcatcactgagggctggccatggtggctcacgcctgtaatcctagcactttggaaggccaaggcggttggatcacctgagcacaggagtttgagactagcctggccaacatggcaaaaccctgtctctacaaaagatacaaaacttagccgggcatggtggtgggcacctgtagttccagctactcaggaggctgaggtgggagtatcacttgagccctagaggtggaggttgcagtgagccaagattgcatcactgcactccaatctgggcaacagagcaagactctgtctcaaaataaataaatcatcactgagtgccctgaaagtgaataattaatgtgatgcagttaatgcaatgcaactggacctggttgcattgataaatgagttttaactgggactttgccaccaactattatgttgtctggctttgtttttccacctttttgagccttggttattaagaacattgagaataggtgaggaaggaggaaggctagtaaggagcagattataggaagaggttatcggggatttggttaaggaaggtagagatgagatcatggctcactccagcctccacctcctgggctcaagcgatccacccatctcagcttccagagtagctgggactacagtgtgcaccaccacacccggctaattaaaatacatttttttttttttttgtagagacagggtttcactatgttgcccatgttggtcttgagctcctggactccagtgctcctcccaccttagcctcccaaagtgctgagactacaggcatgagccaccatgcccggcccgagtttcaaaaaatactatagaaaatagtttgtataattcatcccccccaccccaacccccacttgatgagagtggcgtgaatctagaaatgacaacatgtggctgtggccagactatagcaaacaaaaagccagtgagcattgaaggtgatgctcatgtttcacttgtgaagacgaaacatcttgggccgtgattaggaaagataggcaaagggggtggaaatgataagtttaattatgataatagtatcttatcccccatgcttctacataatagctattgttctttctgtttttatagattaaaatattgaggcctagagagcttaaattaattgcctaaagtcacatggctgtaagtgatagcacattttaagattgcatcaggacatagaataagacttagtttccaattctagcaaagcccattatagaaatcactaggatatacaggaactagcgtggtgggtatgaggttgtttgggttttgaggtgcagcatttgttgcagagcctcctgctttgacgttgttctgcctgataattaaaagccctaccctctgcctgctgggctgctgcaggggccaggcatcactgtcgcctttatactctgactcttttttccccctttcctgctttcaggatgaggccattcctcaaaatagtaaaaaggccacacagtgaagcctgtaccccccaggtttgatttcagaaagcttttattcaacttaatgacagtttattctttcaaaacaatatattgaagtattacacagagttcactattgtttcataatgtcatatgatgtaatgctaatgctggtgggtgatctgcagaggcagtggctgggcgagtttggggctatttgtatgactgaggtaatgtttgcatttttaataagcaagcagattctttctttggccttaacccttttgcataaatataccagagtataatttatgctccataatccaaatatctgttcctttttttatcaaagggatttctgtttttcatagcaatgtctgaattagtaatttattttgacatgtaaagcattttataggaaatgaaagattagaaaattagaaagtagctacaaatggctgtgacagaacacaaaggcaaaatagtagatttgatgtaagttagcaagattccaagaagttaacaaaccctgtatagatttcttacttgaaattcaaccactcatattttttaatgaatcccactctattgtatgtcattctaaagaaatgaaatatttgcaagagaaaagtaatatggttggtgttttatatataaagttacaaaaataattattcactcttagtagatgaatatgtgcatatttacacacatgcatgcatgtgacattctttccaaccgatctgtcatttttgttactgaccttggatacaacgtaagagattgtattgctgcctatggaaggggctgtttttgttaataacaaggatgatcaaacatatacagtgtagatactgaagtgatactaagcagctttgttgggagtttggtgtttggttgttaagaacatgatgcatgtgaagtagattttgataattaaaaggagcctggggcttttcatagtggagcgaaatctcatggaacagcagtgaaagctttcaaatcacatggaacattgagaactggaacctgaaagtgtagctagggaagaatgaagcaatggaaaaagggcgataaggagagcatgatggagctagatttcaaatgaccagtttcttcacattcttctgtcatctggacaaataaaagtctttgcattcatcagatgtctgcctctaccagctgtcagaccttatcattgcattggaaaatggcagccaaaggaggggacaagagaatggatcttaatcagagccacagtcttctctgaatggcttaaaggtaatctctaaacccaggggtaatcctaagtatattttctcccaaataccatattggaaagattgatgacttattcctgattactttatgggtttgtatttgtaatagctcttcagttaagcttttaaacatggctattcagagaagtgtgagttgtgtgtaaaaacaaaaacaaaaataaacatagctgtttaccagcattgggttagccttactcagaagagtgggaagtaccaggtgaatggttgctttcaaccgattgagaaagtgaagctgtctcaccagaacaccctcatcttttcccttactcccataaatctctgtgtgcctgcatccattcttgtttctttccattaagtctcagatgaggtattcatgcctttctctgaaacttaatgccattctgtttcactctttccatttgctgggactttgctcctgtccttttctctttttgtctcgcaactagcttagtggacctctttcctcttgttcagatatacagctcttcccatcttaaaaacagaagacgaacactttctttcaattcagttgccctcttggctaccacgctttctctgttctcatttctgctgccaaacttactgactccatgggtgctacatgctgtccctgcttccttgatacctctgccatttgggaagttcccctggacaggctctcatatacataacttcatccatatttgctgctttggaggattactagtgttttcttttcatgcttgaagtttttttctcagtccacatcctcctcttcttttccgtatttaacataggtttctatcccacttgttaaaactcccttcctttagtttatgatacctccccacccagtggtattctgttttgtttttttttttttaatctactggttagtctctattcctctctgcacagcattttgcctagtgctcttttggaaaaacaagattctaaggcgctttaagtattctgaaatgtagccattaagatgattttaagtctctgtcatcaacttcaacttttttttcttttccttcttcttttttttgagatggggtcttgatctgtcatccaggctggagtgcagtggcacaatcatagctcactgcagccttgacctcccgggcacaaatgatcttccaacctcagcctcccaaggagctgggaccacagatgtaccacacctggctaattttttttttttttttaatttagagatggggtgtcactctgttgtccaagctggtctcaagccctgggctcaagcagacctcccatcctggcctcccagagcactgagattacaggtgtgacccactgcacctggccagcttcaactccttgttctgtttgtccatcatcttgctctgtttgtctatacagtcgctttaaattcagcgtattccatcttccacttgtgtattatgtatttattcattttatttattcaacaaacactggatcttcttaggcaagtagtgtacacttgaaaagaatgtgttctgtagttaatgggtatagtgttctataaatatcacttaggtcaagaaatggtgatgttcaaatcttgtgtgtgcatattgatttatttcattaatttgatcacttaatgaaagagaggtattcaaatatccagctatttttgttaatttgtctattctggttattccattggtttctactttgtgtgttttgaaagtctattattaggcatatatgcattaaatattattatattgatccttccgtctttatgaaaatgtgctacctatgtgttattacccctgtcttgtagtctaatttgttttctatcaatatagccactccagctttcttacacttactatttgcatagtataccttttactattctttacttatttttatcgatttatgtctttatatttaaagggcatctcttgtagacagcatatagtagggtcttgcttttgtatttaggctatcgtctgctttttaattggtgtgtaaattgatatggttggatttaggtctcccattttgctcttcattttctatttgtgctgtgtgcttttggttactttcatactcctttcctgcttccttgcattacaaaaatttttttttagtatgtattccattttagtttcttttctggctctttaagttatactcctttgcattatttttttagtggttgctctagaggttacaatatagtcttgatatttattatagttcatttagaattactattgtatcacttcatgtaaaatgtaggaaactttcaatggtgtggtttcattcaccccccacttcttttttttttttttttttttttttttttttgagaaaaagtcttgctctgtggcccaggagggagtgcactggcacaatctcagctcactacaacctctgcctctccagttcaagtgattcttgtgcctcagcctcccgagtagctgggactacaggtgtgcgtcaccatgcctgtctaatttttttatttttagtagagatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacgggatttcactgtgttagccagggtggtctcgatctcctgaccttgtgatccgcccacctcggcctcccaaagtgctgggattacaggcgtgagccactgcgcctggcctactgtgtccttttaacatattccccttatactttgaaaatgtctttattttctggcacaatataatgttccagacttattttgttcttccatgtctccagctctagaatcgggtatttcttaaaggaaccctggttcttttagtgaagggtcttatttagaatccatttctggaccttctcagaagatttagctagggaatccatagatacacacccacacatttacacctatgtttattttttatatgttcgtgtatttggcaacacgatcttgccctttcaccctggctggagtgcagtggcacaatcacggctcactgcagctttgacctcctgggctcaaggaatcctcctacctcagcctcctgagcagctgggactactctgcgtgccaccacgcccaactaatctttttgtattttttgtagagatggggtttcccaatgttgcctaggctagtctcaaactcctgggcacaagcgatccacctgcctcagcctcccaaagtgctgggattgcaggcatgagccaccatgcctggcctatattttctatatattgaaaatgacaagttcacactaatatgttctctatgttctttgatctgcaggtttgtacttttaatcgaaaactttggtcattatgtcttccaatatttttctgctccccccacctgctttttgtgggacgccaattcgatgttagaccgcttgatattttcttacacatcactgacacacctttcaatttttatttttagtcttttcctttctgtccttactttggataatttttactgctgtgtttccatgttcagtggtctttttttctgtcatgtctgtactgcttttaatctcatccaaggtgttcttaatttcagatgctggtatttttcagctttagattctcccccttaaatgtctttgatctctctgcttatcatgcttatgttttcctctactttttgaacgtatgagtacttcaattttattttaattttatttttaagagggagtttcgcccttgtcgcccaggctggagtgcaatggcacgatgtcagctcactgcaacctctgcctctagggttcaagcaattctcatgccttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgcaaactttgctctctctctaactcagtgaggctgctgggctttttttgatgtccattctgctatggactgaatgattatgtctccccccaattcacaggttgaaattgtaatccccaatatgctgtattaggagatggggccttgggaagtgatttgatcatgagggtggagccctcatgtcatgggagtcacgcccttacaagaagagaggggagagaggttccttcttccttctgttcttagccatgtgaggacacaaggagaagacagccatttgcaaaccaggaagagtgccctcaccaaatatccaatgtgctagcacctaaatcttgtacttcccagcctccagaactgtgagaaataaatgtatgttgtttaagccatccagtttatggtattcttgttgtagcagcctgtaccgaccaagacacctccctggtctgcctcttggaaactgcctttaggtaataagctgggaaaatggtagggcttgttttccttctttcagggatcaaagtcctgtgctgcctgttatacagtatcggaaatgagtgtttcatatatttttgtctggttttctagttgtttattattgcataatagcagttaatccttcatgtgcagaggcagaaatccttaaaaaaatgctttttaatccatatttttctgtccgataccagtttttccattttacttataagaccctcctgccaacagcctttaattggtcattcatttctgcaacatattgataagcacctgctaagtgcctgatgtggtcagacagtgcaggtacaaaaaatagaagacatagttgctgccctttaggaccttattgttttgtgagcgatttagacaggtaagtattcacaataatatcatattagtaacactggccacatgtcccaaagagtagataaacatggaggagataattattaatttggcctgggaatttggggcaggcttcctagaggaagtagaattcagctgagctttgagggatgaatagcaggtagctacatagagaaggcagggttgcagagagtattcttttttttttttttttttttttttgagacggagtctcgctctgtcgcccaggcttgagtgcagtggtgcaatctcggctcactgcaagctctgcctcccgggttcacgccattctcctgccttagcctcccgagtagctgggactacaggtgcccgccaccacgtctggctaattttttttttgtatttttagtagagatggggtttcactgtgttagccaggatggtctcgatctcctgacctcgtgatccgcccgcctcagcctcccaaagtgctgggattgcaggtgtgagccaccgcacccggccaagggtattcttagtttaaaagtcttctatatatattttaaaacatatttaaaagatgctggccagtcacagtggctcatgcttctaattccagcactttgggaggccgaggtgggaggattacttgagcccagaagtttgagaccagcctgaacaacatggtgagaccctgtctgtactacagaaaaaaaaaaaaaagtttatctaggtgtggtggtgtgcacctgtactcccagctacttgggaggctgaagtgggaggatcacttgaccctgggaggtcgagcggtgttcatagcgctgtactccagcctgggtggcagaatgagaccctgtctcaaataaaataaaataaaataaaagatgccaaaaagaattcttaaccaggtcgggcactgtagttcatgcctgtaatgccagcactttgggaggctgaggtgggtggatcacttgaggtcaggagtttgagaccaccctggccaacatggtgaaaccccatctccactaaagacaaaaaaattaaccgggcgtggtggcgcacagctgtaatcagctactggggaggctgaggtgggacaatcgtttgaatgcaggaggcagaggttgcagtgagctgagattgcgtcactgcatccagcctgggtgacagagtgagactgtctcaaaaaaaaaaaaaaaaattattaaccaagtttgtatttggaatatactgcttttcttttcttttctttttctttttcttttgagctggagtctctgttgcccaggctggagtgcaatggcgccatcttggctcactgcaacctctgcctcctgggttgaagcagttctcctgactcagcctcctgagtagctgatattacaggtgcctgccaccatgcccggctaatttttgtatttttttatagagacaatgttttaccatgttggccaagctggtctcaaattcctgacctcaggtgatccatccgcctcggcctcccaaagtgctgggattataggcgtgagccactgtgtccggcctgtagaggaatcttaaaactgtcatagttggcctggtgcagtggctgatgcctgtgatcatagcactttggaaagctgaggcaggaggattgcttgaggccaggagtttgagaccagcctgggcaacatagacctcatttctacaaaaaatttgaaaattagctggtcatggtggcatgtgctggtaatcccagctacttaggaggctgagatgggaagctctcttgattccaggagtttgaggctcagtgagctccagtcataccacggcactccagcatgggcaacagagtgagaccctgtctctgaaacaacagcaacaacacagtcataggtatttaataacgtttaaatattttttccatcaaaattcagtttcacagaaagccagtgaaatgcaaagtgacattttaaagaatgcacttggatagataatcatttgcttctaccaactggtgaaaatcatcagcaaaagttagtaatcatggttttttttgtttgttgttgttgttgtttttgagatggagtccagcccaggctggagtgcaatggtgcaatctcagctcgctgcaacctctgcctcctgggttcaagtgattctcctgcctcagcctcccgagtagctgggattctaggcgtccaccaccgcgcacagctaatttctgtatttttagtggagatggggtttcgccatgttggccaggctggtctcaaactcctgacctcatgatccgcccacctcggcctcccaaagtgttgggattacaggtgtgagccaccatgcctggtctgtaatcctgtctctaaacatttttagcagtatatgaaagtgtcagtaagtaaatatttatgaacaaaaagtctgttttgatttgcaggattttcggaacaggtgacaattgggattgctttgctcttcagtcttttttttttttttttgagacagagtctcactctgttgcccaggctggagtgcagtggcaccatctcagctcactgcaagctctgcctcctgggttcacgccattctcctgcctcagcctcctgagtagctgggactacaggcgcccgccaccacgcccggctaattttttgtatttttagtagagagggggtttcacagtgttagccaggatagtctctatctcctgacctcgtgatccacctgcctcggcctcccaaagtgctgggattacaggcgtgagccactgcacctggcctgctcttcaatcttttttaattgagggcttttctctaacttaaagaatcagtatctttttatttcagtaaatcttatgttatgtcaaaattaatttttctcagccataggagaaggaaaaaataaatccaacagagagttaacagttacataggccaaaggcaaattaataataaatgccataggtctttctcatattttgccatttttaaaataagatggccttcctttagtgtagtaattaaatttatagcagtcctgtgtttaacaacacttttaccactagatgtcactagactaaaacaattggtaagcttgttgaaactgctgcaacctggtgcagtcttttcaaaggcctttggttaataaggcttcctctgtagcacctgcatttctcataaaactaagtcacagcttgcttcaagcacaagctgattgggaaatatacatgttctgtgacacgttagtaatctagaattacttattttagtgtttatcaggacagaaaaggacaaatcttactaccggaggaaactttttagtgaccttaattttttggagagaaaacgattttcagtctatctctgtactcagagaagcatttatcgtcacacctcaggtttctcaagagttgagattttgtccttttttttttttttttctcgagacggagtcttgctctgttgcccaggctggagtgcagtggtgtgatcttggctcactgcaagccccgccccgccaggctcaagcaattcttctgcctcggcctcccgagtagttgggactacaggcgcgcaccaccatgcctggctaattttgtgtatttttagtagagatggttttcaccatgttggccaggctggtctcaaactcctgacctcaggtggtctgtctgcctcagcctcccaaagtcctgagattacaggcatgagctaccatgcccagccaagagttgggattttgtcttagacatcgtggatttcttagggcccagcacaaagcttggcacttggtaggtactcagtaaatgcaattaagcattagggtagtatactagatgtcatgggggaaaagatagctcacaggtcctctgctctcaagaagtctcatttgggagataatacatgcccacagcacagggtattgtatgtaaaccaaatgagtagtgcattcactagcttctgtagtatttcaggggatcagtagctcttgagagctagcggtagtgatcaaaggtgtccttaagagaaagcatatttagagatgcaaaagtaggacagttacaagtgaagaaagcaatgagccaaggtttaaggataggaaaatgcaggcagtaaagatttagaaagataaaaactcaagggccctgaatttaaagcatacatttaggtttaatattttttagggatattggaggggacattgaaggatattggtgtgggaaaataatatgttgcatgatagtttgtaatttacaaaacaatagcacttgaagaagaatgaattaaagatgattgctctttgattttaaaatacttctgttttaaagtctattataggccgggcacggtggctcacacctgtaattccagcattttgggaggcctaggcgggcagatcacctcaggtcaggaatttgagaccagcctggccagcagggtgaaaccccgtctctactaaaaatacaaaaagtagctaggcatggtggcgtgcgcctgtaatcccagctactcaggaggctgaggcaggacaatcgcttgaacctgggaggcagaggttgcagtgagccaagatcgtgccactgaactgcagcctgggtgacagagtgagactccgtctccaaaaaaatacataaagtctactacaaacacttttatttaaaagagagaacataggcatagggcttagtatatagtacctctcacttaataaaccctcagtacatgattcttgttgatagtaatattattaaatgaggaaaaaatattagagacatgctacaaaataactaaccggttttctttataagagtcaaagtcttgaaagacaaggaacaattgaagaattatcacagatttaaggagactaaggagacatgcagtgtgggtcctggattgggtcctagaatgagaaaggatgttagtgggaaaaaagggcacatttgaatagttgtgtagtttagttgattatattgtagcagtgttaatttcctggttttgatcattgtattgcagttacatactatgttaatattaaggggaagctgctgagggtgtagtggtgagatcatgactcactgcagcctcgacctcccaggctcaagtaatcttcctgcctcagcctcctgagtagctgagaccacaggtgtgtgccaccactcccagctaatatttttaattttttttgtagaaatagggttccgtatgttgcccaggctggtcttgaatttctgggctcaagggatcctcccacctttgcctcacaaagtgcttgggataataggcatgagccattgcacccatctggaatcctatactttatgcaacttttctatttctttctttcttctttcttctttcttttctcttttttttttttctttttggaggcaaaaatcttgctttgttgcccaggcttggagtgcaatggagcgatcttgactcactgcaacctctgcctcccgggttcaagtgattctcttgcctcagcctcctgagtagctgggactacaggcacgtgccaccatgcttggctaatttttgtatctttagtatggtttcaccatgttagccgggctggtcttgaactcctggcctcaggtgatccgcctgcctcagcctcccatagtgctgggtttacaggcatgggccaccacacctaagcctgcaacttttctttaacttcttttgctttttttaaacttcttattcaaaaatagtaagtttaaaaatacaattttgttttagaaaagatttcaattttgtatttgaactaagttatctactgagaggtcggatgtcaacagaaagaatttagaatctcctacccgacagagcttttaagatccactaaagcccattaagcaatccactagaatagcttaaggcaagagtgggttcccttgaagacccagaagtagaacctctgaggtgcttccttgattaggctttgtctcagtggaatgttggagctagtttgattgtctatccagaccattaaaactttttatgtcagcactagggctgtttttgcctttgtgtgttcactggagtagcacttttaattccctttaagaacttgtcctttgcattcacagcttggcaaactggtgcaagaggcctgacttctaccctgtcttagctttgaacataccttcctcactctagcttttgatttaaagtgagagatgtgcaattcttcctttcacttgaacacataaagaccattgtaggggaattcattggcctgatttcaatattattgtatttcagggagtaggtccaaggagagggtgatagccgggggaatgattggtccgtgaagcagtcagagcacatgcaacacttctcagtttaagtttcctgttttctatgggtgtggtttgtggtgcccaaaacaattacaatagtgacatcaaagatcactgatcacagatcaccatgacagatatcataataatggaagtttgaaatattgcaagaattaccaaaatgtgacagacatgaagtaagcaccctgccacaaatcttcaatttgtaaaaaaaaacacagtatctgtgaagcacaatttaaaaaaaatttgaagtggaatagaatgaggtgtgcctatatatggaagatggcttgatctaatcagagataaaaagagatgaatgaggaccatatcaaaattatttccagtttgcagttaattctgctcccagtctccagtcctaggcaaccacaggccagcttttctggacacttcatctaaatggaatcatacaatacatactcttttgagtctgacttccagtttttgcctgttatgaataatgctgctatgaacctttgtgaccatgtgttcatgtgaatgtgtttttatttcttttgggtggattcttaggaacggaattggtaggttgtatggtaactttgtgtttacttttacgaaactgccaaacttttttcaaaattaccattttacattccttccagcaatgtatgagaattcagtattctctttatttctgattatagccatcagagtggttgtgtagtggtatctcattatggtttacatttacatttctctaatgatgttgagattatttttgtgtgcttgaaatacctgttcaaatctcttatccatttttaaattgggtttttaacttatattgtattataacaagttctttattctggatacaatctcttaatcagatatatgatttgcagtattttctcccagactgtgactttcttttcattttttgggggattttttttttttttttttgagaccgagtctcactctgtcgcccaggctggagtgcactggcgcgatctcagctcactgcaaactccacctcctgggttcaagcagttctcctgccttagcctcccaggtagctgggattacgggtgcctggctcatttttgtgtttttagtagagacaggctttcaccatgttggccaggctggtctggaacttctgacctggctgatattttttgaagtacaacttttttaatcttgatgaagttcagtgtatcaatatttttaataaagatttctcctagaagttttatagttttagtgattgcatttaggcctgtgatcctttttggattactttgtgtgtgttgtgtaaaggtctaagttcattttgctttgtttgtttgcttgtggtatccagttgaccctgtaccatatgttgaaaagattgtgttttcccttattgaattatctcagcacctttaaaaaatgaccataaatgtaagggtttatttctggactcttaggtctgttccattgatctgtcccatttttaatttcgtggattgtactttggtgttgtatctaaaaagtcatcaccaaatccatgcttacctagattttctcttgtattactgcttaggactttcatagttttgcattttacatttaggtctgcgatccattttgacttaatttttgtgaaaggtataaaccatatgtgcttttaaagactatatagtctgcagtcattgggtagagagttttatatatgtcagttatgttggttgatagtgttttttgagttttgtatattcttactgattttgtctttagttttatcaattgagagtgaggtactgaattattaacctgttttgttgaattgtgtatttttccttttgattctgtcagtttttccttcatttgttttgaggatatgttgctggtgtggatacatttagaattattatatcttcatgatgtaacaactttcatcattatgaaacaccgttctctaatattactctctgtctttatttctattttatctaatattaatagagccatttgtgttagtccactttgagttgctataaaggaatacccgaggctgggtaatttataaagaagagaggtttatttggctcacagttctgcaagctgtataagaagtgtggcaccagcatctgcttctggtaaggacctcagaaaactttcaatcatggaggaaggtgaaggaggagcaggcatgtcacatggtaagagagggagacagaggtgggggaggtgccacactcctttaaacaaccagttctcccataaactaatagagggagacttgctcggtactacagggaggcaccaagccattcttgagggatctgctcttatgactcatacatctcccactagaccccacctccaacattaggggccacattttaacatgagatttggaggggacaagtatccaaatgatatcactattctgtctttcttatggttctatgatggtatatatcttttttttttttttttttgagacaaagtcttgctcgacaggctgctgaagtgcagtggcgcgatctcagtttcctgcaacctctgcctcctgggttcaagtgattttcctgcctcagcctcccaagtagctgggattacaggcgcgtgccagcatgcctgtctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtttctctgttcctccttgactgcctccttttatattaaatacatatttttagtttactgttttaactgttccattgattttttttaactatgtattttttggagttgttttcttagcagttgctgtagggattacagtgtacatgttaattatcagagtctacttcagattaatactaacttaattctggtaaaatatatatgctttgctccattatagcctcattctttcacccttttttgtgctattattctcatgtataatatctgtatatatttgtaaacccaaaacacagtgtcatagttacttccttaaggatgtttgtcttttaaagaagttaagagaaggtgtgaataaaaatatatttgtagaatcttctgtgttaactcacatatttacaatttttggtgttcctcagttcttcttggacttcaggtccccaaccgttgtcacttccttttaccctgaaaagacttttgttagtatttaatgttacaaattcactagcagattttctcagtttttgtttatctaggaatgtctttgtcttttttttttttgagggataaatttgattgaaatggaatttttggttgacaatttttttcccccagcactttatatatgccattctactctcttctagcctccattgtttcagacgagttgcttttctcttgctcatttcaggatttttttttcctttagctttccatagtttgtgataagtccaagttttgatctctttgtatttatcctacttggggcctttgagcttcttgaatgtgtggattaatatttttcatcagatttggtaagtttgtctcttctttccttctgggatttccattatgcatgtgttggcatgtttgttgttgttgcacagatctctaaggcactgttttattttctttaatcttttctctttgttctttagataatttctattttcaggttcactgattctttttcctgccatccccaaattgctattgagttgccccagtgaatttttcatttccattattatacttttcaactccaagatttctgtttggtttcttatttttaaaaattttatgtatgtatgtatttgtttgtttgttttgtagagacaaagtctcattatgttgcccggctggtctcaaactcctgggctcaagcaatgtgctgaccttggcctcccaaagtgctgggattacaggtgtgagccaccgtgcctggcctgctttttaaaatatatatataatttctgtctccttatagggaatctgaatttgtagattcattgttatatttttctttcttttattatgattttctgtagttctgtgagcttataattgctttgaaatttttgtctgctgtatctagtatcttcaatactcagaggcaatttctattgactgcatttttttcttgagtacgagtcacactcctgtttctttgtaggtcttataatttttttgttaagaactgggcattttagataatatagcagctgtggattctgatcctcccaaattgctgttgttacttttttgtctgttcattgctctttgtttagtaacatgtttgtcaaacctgtgaaatctttttcctgtggtttgtggccattaatgtctctacttttccaccccacaccctcctttttaaaagacgacaatcactttattatctctcagatttctgtgggtcagggattctggaagggctcagctgggcagttctgactttgttatgcagctgcagtcagttggtggctggagctgaaataacaggggctggagcagctgggggccgtctgggcagctctctttatttgtgtagtctcaggtcctctccatgtgtctgcttgctttttaaacttgcttatatctttacatctgctttcctaggggttgtccatatgtctgcatgggttaatagtcagttattgatcagaggttgtacttaaccaccttgatcaggaaggcttctgtcatctgtaaatggctctgcgtggcagggtagcacattcaaagttcaggccattttcaaatcttatcttttgttcactgctgaaccctttcacctctccccttggaatacacacaccctcagtgtcagctaggagcacgtgactggttgcaccctttcaggtctctgctgcaaatgcatacagccttagctaggagtaagcttgccctgaccacgaccacaacctcgtgttagtatagcttttggcactttccacttgcccatctctgagatagtcaattctactgatgacaccgctggatgtggatgctacctattgttccaaataagtcagcagccgcttcctgctaaagcaggaaagcttcctgttctcattacctgtcccattctggtacaacatctgcttcaactgaggcaggaaggttgggagaagcctcacatctcaatgacacagattctcactatttttacccaagttctttttttttttttgagatggagtcacactctgtcactcaggctagagtgcggtggcacaatctcggctcactgcaacctccaactcccaggtttaagcgattcttctgcctcagcctctgaagtagctgggactgcaggagcacaccaccatgcctggctaatttttgtatttttagtagagacggggtttcaccatattggctaggctgttctcaaactcctgacctcgtgatccgcctgcctcggcctccccaagtgttgggattacaggcgtgagccgccacacttggccaagttcattcatttttaaggcataaatgcttctcaaatttttatatgccattggttgattttccaaacctcaaaatggtttgaattatgtttgaatggtatgaattatgttcagctttatagttaccttttgcagagaggatatgttgatctcctcatttggatttatcaagaagtcccacttgtctgtccatgtggtttttttttttttggagatggagtctcactctgtcgcccaggttggagtgcagtggcgcagtcttggctcactgcaacctctgcctcctgagttcaagcgattctcgtacctcagtctcttgagtagctgcaattacaggtgtgtgccaccatgcctggctaatttttgtatttttagtagagacagcatttcgccacgttggctaggctggtcatggactccttgcctcaagtgatccacctgcctcggcctcccaaagtgctgggattacaggtgtgagccactgtgcctggccccccatttgcttttaatctagcttttaaagtagccagcatatagttgtcttgctgttttatatatgttgaaaatctgtctttttaatgatatctttaacactcttagatttagtgtaatttcagtgtggtggggttaaagtccactgttgctattttttttttttttatttgttctagttcgttctctttttttgagacaaagtcttgctttttctcccaggctctagtgcagtgttatgatcttggctcactgcaacctctacctcctgggttcaagcaattctcctactcctacctcagcctcctgagtagctggactacaggcacgtgctagttttttgtatttttcatagagacagggctccactatgttggccaggctggtctcgaactcctgacctcaagtgatccacctgcctcggcctcccaaagtgctgggattacaggtgccagccaccgtgcccggcctttgctcctgttctttattccttcctccctgcccacccatacctttttctgtctgctttaggattgagtctttttatgttccaatatttatctgcactgttgggttattatttttatgtatgaatatatgtattttttttctagagtgcagtggcacaatcatagctcactgtaaccttgaactcctgggctcaagtgatcctctagcctcagcctcctgaatagctaagactacaggcatgtaccaccatgcccagctaattaaaaaaaatactttttttagaaatgtggtcttattgtgttgttaagactggtctcaaacacctggcctcaagtcatcctcttgcctcagccccctgagtagttgggattgcaggtttgagctctcatgcctagcaagattcattatgtggttgtatcaatagtttgttccttttattgtttccttcttatggatataccatagactgtctatccatttgccagctgaaggaatcggggttgtttccagtatttggtgattataagtaaagccaacataagttttgtggcagttacaatatatgacagaattgcttcccaaaggatttaataaactaattcatagtaaaaacaatactatctgagcatttccatttcataatatcctcttcaacactgggcattacttaaggatttgttttctccaaaatggaagtatcttttattctgatcatgaaagtaacacgtgctcatgattttatgtcactcagccctctgatccgaaacctaaatatactccattttgtctcttttgttagagcatgacccccagaattggcatagtgttccaggtgtggattggatccagtgtcttttctgcatgatatattccttttaatacagcccaagtttaagtagcttttttggcagccacatgcacttgagtcatatcgaatcatctaaaactctaaagtgtttttcacatgtgctgacattaagccacacctcccccatcctgtatttctgcagatagtttttggaccttcagtgaaagactcacattcatccacagttcagtgtcacatgtagcctcagtttctagcttgttgaagccttttttgaatccccacgattaacacaccatgaggggcctcactcaagtcattaaagaatgtttaacacgacagaacctaggtcagagatccagggaaaagctcatcacagtcaacagacacagaactctttctgttaagaatacttttttattttccagtttctagttggtatttttgtgggaagtaaattgctatctcatatgcgattagtgagaactaacatttgtgattattatattaattgagactctttttggtatctgattatcagtaccatgcttattatgtatatcattaatgcagtttttattgtggtattttatcaccacaaactgtatttattactagtctatacttatttaaaacattgaagtgtttttcctgagactttaaaccacatcctaagaccacacttcccaaacatatggtagcagtgaccagagacataaaaatcacaccattgatgagagagtaatgattctaagacctgccccaaacctcaaataggatagcaatgtcatggctgctcctaatttagatgggacgaaatcaacaaaaaggaactgctggccgaggatagttaatattcaaaagcaaaagaaatgtatctgtaaataaggaagataaatctcattataatatccactgcttttttttggatgtggtcttccagcagtagtagataagtatattattaatgaaacaattgtgttagtgttccataattatacaaaaagggaaaataggacaaggcatgaataattaatgaaaggaaaccagactcttaagtggggtgggggggacatataagaaaaggtaacagccatctgtgagtctggtctgaggaccagaggatggctgacatttttggggccagatagactatctttctgctgttcttctcctttcctggcaatatactggaagagattgaaacagaacatcaaggcaaccccacacatgagatggaaatttaaaaaatgttccagatatgagcataactccctaagccattcttttagcaatggttgaagccagtcctctgacttgcagtaagttctcgcaagaggctacagttccgaggcctatttattttggcctcatttttatccctacttttactttggtgacattccttgagtctcactcattccagcatagggacaggacacaggttgttgaggcaaatactatgggttcatatagaaagtaccagatattaactatctctggccagagtttttcccctaggtccttacaagtaagtactttttttttttttttttttgagacgcattttcattcttgtcgcccaggctggagggcaatggtgcgatctcggcttactgcaaactttgcctcccaggttcaagggattctcctgcctcagcctcccaagtagctgggattacaggcgcccaccaccacgcctggctaatttttatatttttagtagagaccaggtttctccatgttggctaggctggtctcgaactcttgaccttaggtgatccacccgccttggcctcccaaagtgctgggattacaggtgtgagccaccactcccagccaaataaatatatttttaatgcacatttacaattctaattagttttatatacctctgccagtatcttttaagcccaactgaagttatgtgattcctctgcagaattggttgctccatcctgcctacaaccaattctgatgcaggtatgagctcctcagcttgaggtgaagatctcaagcagcctttatcttaaaaaatttatttcgttttatgtatttattttttgagacagagtctcgctctgtcgcccaggctggagtgcggtggcatgatcttggctcactgcaagctctgcctttcgggttcaagtgattctcatgccacagtcacccgagtagcagggattacaggcacatgccgccacacccagctaatttttgtatttttagtagagacagggttttgccatgttggccaggcttatcttgaactcttgacctcaagtgatcttcctgtctcggcctcccaaagggctgggattacagccatgaggcactgcgcctggcctcaagcagtctttaaatcttcatttcccactgtgtgctttgtattgagctccaggccaaatcggactgttttctttgctttcccacctctaaactttgcccatgcccttctatctgataaaaagccatcttttccacataggcctgctaaaatcttttcattcctttaatgattcctttttagattcctttaatctatcattccttcaagattttgcttgttcatttgttcagcaaatatttgagggctgctatgtgttaggcactgttctaggaggtgagggtatagccaaatacacaatctctgctttcaaagagcttacattctaatagttcatcccactagaaggcaagtttgtcttagaccatctccttcattatcttttttacctttcctaaattgatacaatctttacatagatcatgatgaggaaggaggtaatatatttgaagtgaccactgtggccaagcacagaacattgcaaaatgctttaattttaaaagcatgtgtcctaaatgtagaaggaaggataactagaaatacagaaagttatggtcagaaagccgggggtggtggcatgtacttgtaattacagctacttgggaggctgaggcaggaggatcacctgaggccaggaatttgagaccagcctggtcaacatagcaagaccttatctccttttttttttttgaccttatctcaataaggtggatgcacctgtagcctcagctacttgggaggctgaggcatcaggattgcttgagcccaagagttccaggctgcagtgagctatgactgcaccactgcacagcagcctgggtgacagagcaagaccctgtctcttaaaaaaaaaaaaattatggtcaaagcaaaagcagtaataagtaggatgaccttagatgatccaccttccttggcctcccaaagtgctaggagtacaggcataagccaccacgcccggcctaaactgccatttttaatgaattgtaaagaacagaagaggtaccagaagcttagaaatagaaaaaagtacacgttaaaaggggaggcgggtaattgaacgaggggccatgatttcaaaatttccatccattggttccaactctgtgccttcagcgcttgttctcttttaaagtattgatagactactattgtgcatccagtcagtcttgttttgtcacactaaaaatttcaagataagtccataacaggagcataagtaagatactgcaaggttctgaccttggcctcaaccttactcaagatcatatcacttagcttggttcctgccatacttagcaaaggaccctatacatgctagatacttattgaagatttgtggactggacttaaataaagaggtagaggcatatcaatcacattggtaggtggtaaagtgttggacagaatatctgacacaatggatgacagaatcaagggtcaaaatgacctttttttttgagacagagtctagctctgtcacctaggctggagtgcagtggcatgatctcggctcacttcaacctccaccacctgagttcaaaccattctcctgcctcagtctcccaagtcgctgggactacaggtgcacgccaccatgcccggctaatttttttgtatttttagtagagacagggtttcaccatgttggccaggctggtctcgaactcctgacctcaaatgatgcgcccgccttggcctccgaaagtgctgggattgcagacgtgagccaccacgcctggcacaaaatgatcttaacagactgaaaagatggtctgaaaccacaatgacatttaaaagcaatacagctgggtgcagtggctcatgcctgtaatctcagcactttgggaggccaaggtgggcagatcgcttgagctcaggagttcaagaccagcctggccgacatggtgaaaccccgtcactaaaaaaaaaaaaaaaaaaaacgctaaaaatttaggcaggcatgggggtttgctcctgtagtcccagctactcaggaggttgaggcatgagaatcacttgaacccaggaggcagaggttgcagtgagccaagattgcaccacagcactccagcctgggcaatggagtgagacttcatttcaaaaaaaaaaaaaaaaaaaaatagagacaaagctaaaatggtgcagctctaagtccaacgatcataattgtttaagttaaagggatttctgcacacagcaattatttgttgagtccccaatatgtaacaaatacacactactcaaataaattaatcctcccaataaccttctgaggtagaggtattagtgtcccttttagagatgaggaaaatgtgatccaaagaggttaggtgacttgaccaagatcctaaggccaatatacgacgttttcgatctctgaattatctccaaagtctgtgctttttcctatcatgccacactgcccctctgcactctcatgaattgcaggaatttattccaagttacaaagaatcattccagttctgcttaaacatttctagtaattaagatagtttaatactatgcaaggcagcaaaaaggttacagacatagacttttgagaacagtcagatccagattaagaacagctgctcagccacttcttagctgcacaacactggacaaatccttatctctaaacaacagtatccttatctataaattgagactaaaaagtacccacatgacaaggatgctgtgagaattaaatgtgagacgctgtctgaaaagtgcttagctcactgtgtgacgtattgcaattgcccaataaaaattaccattcaaattattatagaaagttctttttatcaaaccaaactctacctcccaataatttctgtccactgatctcagttctgatcactgggactttataaaattagatcaaatcctgtatctatttggcacccatgtaatattagaagagggttatattctgagtcgtctcttctgcaaaccaaaactgtaatctgcttcaaatctccttcataaaaaaaggtcggccaggtgtggtggctcatgcctataatgcaatgccagcactttaggaggctgaggtgggcggactgcttgagcccaagagttcaagaccagcctggacaatatggcaaaactccgtctctacaaaaaatacaaaaaaattagaccagcacagtggtgcatgcctgtagtcccagctacttgggaggctggggcgggaggatccttgagctcaggaggcagaggttgcagtgagccgagattgtgctgctgcactccagcctgggtgacagagtgagaccttatctccaaaaaataataataagacaaggtttctggacaatgacttctatcactcaactcaggatgtaccctagtttaaaaatctcttcttaaacatgacacccagaatactctcgcaggtgtacagtaaccattgccaggtgcctgggactactgcttccactttctgaacttgagatcaaaaaagcccccactgaattgctgttgagccagttttcccacaccctatccttatacaactggttatttttcatctaaatgcaggactttacaggtactgcttttaagtgtttttgttttttgttttttcagatagggtctcactctgtcactcaggctggaatgcagtggcatgatcttggctcactgcaacctctgcctcctgggttcaagtgattctcgtgcctcaacctcctgagtagctgggactacaggagcacaccaccatgcctgcctaaattttgtatttttagtagaggcggggtttcaccatgttggccaggctgttcttgaactcctgacttcaggtagatctgcccgccttggccttccaaagtgctgggattataggtgtgagccatcgcgcccggcctttgtctctatttttgaacattagaattacattatctctcatataatacatgctaatataccaattagaacagaagttttgattgctagacttgattttgtttacaatttggtacagatcaggtgtgtatgtttactttttatggtttttctttcattccccttgctgatagcaagtagcagctactgtcagcttggaaaccaaaataaaatcaatagccctcggccgggtgcggtggctcatgcctgtaattccagcactttgggaggctgaggtgggtggatcacttgaggtcaggagttctagactacactggccaacatggtgaaaccctgtctctactaaaaatacaaaaatgagcctggtatggtagtgcacacctgtaatcccagctactcgggaggctgaggcaggagaatcacttgaacccaggaggcagaggttgcagtgagctgagatcatgccactgcaccccagcttgggtgacagattgagactctatctcaaaaaacaaacaaacaaaagacaaaccaataggcctctgaggcagtctgaagggcttcctgttattaaaatacacaggaattaatacatgggatttaactattttggtgacctgtaggccatttttggttttccctgtttcttggctgttcagggagttggaattattaaataagtaagatataactggatgtcacataatttttgccgccctttaaaaaaaaaaaatttaaagagacagagtacgttgcctgggctgaactcaaactcctgggctcaagtgtctgccttggcctcctgagtagctgggactacagatgtattccatcttgccaggctgatttttgctcctgaggattacaatctagtatagaaaacaaacctcatggttgacttaaagtgtaggattttacaagcatagtgttcatttagtagtgtataatggtatcataccttctgtgtggagtgcctgtttcccatgtgccaagtgctacactggttgtacttcatacaggacctttgcaagtcttcaaaaacaatcctatgagggaaatattaacatcatccacatatagataatgctgagctacagagaggttagacaacttgctcatcttccaaaaagatttaaactcaggtctgtcatagtccaaaggccggatggtttttaccacaggggaagaggtggaccatagtcataggaaacaactgtatatagagaggaatgattaattgagctgaacctaaaaggacaggtggggttttggtgtgatgtgttaggttgggttgggaaggtggatgaaggagttctgggctggcaagagagtctgagcaaagtgggtctgaatatcctgcattgaggagatggggtggtggcagagtgatcactctgtgaccaaagagaaggctgcaatttgagagggagtaagaggatgagacaattattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaactagtaggagccgtttcactgatgcatactcaatgctccctagcctagcatccgcacaatgccttttctggccatggcggagagcacttcaaaaggaggccctgcggagggtggggtgggtagaggagcatggtagggaatgggaggggcaggtgtcttccaaagtttgcagttctcctaacttgttttgccctaggtccgctgaatgcagtattacagtcatggcaaatgtcaccgtactgatgtgcttaacatagatgtaatgttttctagagggtacgctaaaactcttggagggagtggggggtgggggttataaatctttatgttatttttctgttaatgtcaaggaacagttcatccttctgggtctgtatgtttaaactgagagtgaatattaataggaatttacggtactcatgttggaaattgctaccctcatttagaaaccattaacctttatgttaataaaataatgtttttaaatgagcatatgaaatctgtgttgaacagctgcggtctttccggaacactaacttaaaaaatgctcagcatactttttgaaaatcaaaagcatgtgggtgggatgaagtcacctgagcaattttctataattacaactttcaaggccttttcctttgtctttttccagctaacctaaaatacacatgcacgcatgtgcaccctcacacagacagcagcacaaacctgtgattttcttctttctctctatggactttttggccttgtttttgttaaatagttgcagttccctaggaggatatgtgttgtcttgttccttctctagtttatttgaaaccttatatctttgagaactttggaactccccagaacaggctagatgtccacctagactcccaagctttgaatgccctgtcctaaagtatttctaggtgcgttggatctaaactgattcccctagggtgacagtggaaaccccaaaatgccgacatcctagagaatgaccaggaacatgctcaagttgttacacagttttttgtacgtgctgaggttcctcagtgccatcctggtcagccagtactggaatgtgacagaactggcatttgtgcccaggaacagcctacgctgggaattcgcttctgcattctgataattaagtctgctgtgctgctaatattgttccctgaaggaaggagagctagggaataatatcattcccacttgtaccttttaattaacagaggagtggaatggaaagagttttaaagaagactttgatgagagaagatcggtacctgacatagtctggtaattccatcattgtcgaacacattttaagaataccaccgccagttttttcagtgagctaactgaaaataattctaaactttggcttattttatgtgtagaataaaattattgattttccaagagcattcattaagaagtgccttgctaagaagtgttaagcgtgaagtagtgtaatatgtctgtcctactattttaggggtcactccttcttcatcttcctcttctctttcctctaagtaaccaaagctcttcacctagaatggaatttggggcttacattttccttactatcatatagctgtttcttgttaccgaaagcagagagagctttttcagggaggttaaaattatcgttatcttgttatagtgttattttttccttcttagtaagttaggagcaatgctttgtcttcctgaagctgtctgaaaagatgcttgtatacatgtgtatagcgctttgggtcatagaaattaggtgttatgtcatctgtttcagaagatgcactaatgcatcaaaaacaagtgacagggaaaacaatgcagtgagtaatcttgttgcctcaaaactgagcaaacgttttgggagagcaagttcttgcgggacatcactaaataagaatgagttgatgtcacacttggcaagaagcaactctttaaaattttttttttccatacaaatagtacaacatgactgggaggagggattgtgggcaaagggtaaagaattatggagggaaaatgagcaggagaaggaatgtgagaatgagctgcttgctacaaaaataattaatatgtaatcaaagccatgtttgttttgtcaggaaaaatctgagtcagaacatgagctgatgaaggggagagatgtttaccatgtcctcccccacaccctcagagggccgttgtgtgcagatccctgcggagggttgtgtaaccatcttgactcattttcagggaagaatggcccctgtagctcttttggctcaatataatgctgcatcaaggatgagtgaagaagtctctggaatacagtgctatcaaactcaaaatatggtcattttaatgagaatttccaaacactaggaggcaatactgtgcagaccttgtgccaccacctgcctcccccttcccagatatctgtgcgatattgggaattcaggcagcccaatcgatagctgattttaccttttcctacaaggcagaaaatgtcaagattagccaactatttattgaaattagttggagttatctggctacatgagtgtctgtggtccagtgtatcataataagagtgggagagacggttggggtgctactggcatcttgggtgggccagcctttattgtgtgtcactgccgtgtattggcaatttttgtccctgcccactgaattgccagtggtgccccagtctctgcgatggccaggagaggccttccttcttccagattacctctgtgtgtttcaggggggctaaaacagtatgtgttttacagtattactaagcagcacagttttctttgttgttccttagcataaagatcttggaaagttttaagaagttgtgtgtttatactgtagcataggtttcattcaacctatcactcctattcactcctcagagtgaatttcagggaaaaacaacagtattgggggaaaaagtttggaaaaattggatggagggaaggaaaaaaaaaggtgaattgcaaaagggtttcttacgtagcccactattgttccccaaatcaacactcactctccagctctttgggtggttgctctgcattttcaagaggcagcctggggtggaggtcagggttgcaggtaaggtagaggggaaataagagaggacagggaagaggcaggcatgaataaaagatttggattggaatataaagatggaatacaatggagataatgaaagaccataacaaagaaacaggagattttacatggcattgttaagcttacaatgttggcattttggggacaattctgagtaccacagatctagaacttctaaaagaaaaaccctctgagataattacagcagttaaagaccttcacatacatgttgaattaatagtatttaatgtccctttgtaggtttcaatcttttaagcctgtcctgccaaagactgtgtccttctaggtgcttagccagtaatttaggtgtactgtcaccagttgtttccgtcatgacttctaagtctcagcagccattttcccttaggttttattaactgagtcagtaactcaaagtgtcattgttttccactcatctggactttctgaaaataacacagtgctttattggaaaagctaagcatagacattagccaaatgtttgctaaaaattaaccaaattaaatgttattaaataagatgtgcaaatagaggaaaattttgagaagtatgaacaaatcccactaatctttgttgtcagtcactacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaattacctcggtcaaccacatgacaaaagagtgggcatgggttttcctgaatgtctcctgaggtgaccaagggtggagtggtggtagcataataaaccccatgggaagtggagccatagattccatcagctttgcagaggggccttagacccagcagggtttaagaaactgctgtggataggatgccttgtcctccatagagattatcagctgctacctagaatttctttttcatttgcagtatgtcagcatacagaaaaaaaaaaaaaaatagcaaacacctgtgtattcatcaaatttgtcatattttaatattttgccatgtttgcttcagatctctttccctgcaggaagaaaaatacacgtttcaaataaacaacgccccctccccatcctttatatccttccctgatattccctcctcctcccactccacagggaattattgatctgattttggcattcatcatgcccatgtgttttcttcgtggcttgtctttttcctacatgtttttgtatatctaagcggtgtagaatattctttcacttgttttgactttatataagttgtgttctatatgtatccttcagctacttgtgtaactttcttttttcttttccttataattttgagatttatccatgttgatatatgtctcacttattttcactgctgcgtagtattccatcaaatgaatatttcacagtgtatccattgacttattagtgaatatttgagttgtttccagttgttttactattaaacagttttgcagtggacatctttgtacatgtctccttttgcacatgtatgagagttttctctagggtatgtaactaggaacaaattgctgtctagtagggcacatgtattttcagctttactagatacagtcaatttactcttcaaagtagttatgctcttttatcgccttactagctatatattagagttcctgttgttccacatcctcagtaaaaccggatattgtcccagctgttccttgcttattgattaatttaaagacaacatcgtgcttagcaaccatctcaaacatagggtcagatgcaaacttaattttcttataccatgcttcttccttttaaaagaattgttttgatttctgagttacaaatccaagataactataacatagcttttttgccatatttatttttttaataattttttttctgatcacgaaatgaatatatgattattttaaggaacttggaaaacaaaatgacaaaaaagaaaattaaaaattctacctagacatagccattgttaataacttgctatatttttccttctagtgtagacctatgtaaagtatacatttactttataattaaaatttgtcattttatatcacaattttacttaaaattctattgtggcatttcccatgtcattggatattgtttgaaaacatcatctaaggccaggagcggtggttcacgcctgtaatcccagcactttgggaggccaaggcgggcggatcacgaggtcagaagatcgagaccatcctggttaacatggtgaaaccctgtctctactaaaaaaaaaaaatacaaaaaaattagctgggcttggtggtgggcgcctgtagtcccagctactcaggaggctgaggcaggagaatggcgtgaacccgggaggcggagcttgcagtgagccaagatggcgccactgcacttcagcctgggctacagagcgagactccgtctcaaaaaaaaaaaaaaaaaaagtgtaaacagctggataacatttctttttgtaaatataaatatagtttaatcattctcccattggaggacattttgggtattaaaatgatactggagtacaaaatcttggtgcataaatttcatctgagtttgtttctttgggatagatttctagaagccagtaactattcatggaattagattggatagctgataaaagcagggcatcaagggagaaaaaagagttgagagagcaaaacaacatgcttaaggatcatgagattcgtgaattcagcttctgtcatatttgaattgagtggcaaatttgtctcttacctgaatttggagacccttctctaattagggatgattattagagggaaattctgccctactgtggacaccagagagttggttgtgtgttgtagtgttcaagagttttatccaatattctgcttcctgcagagttcctgaattgagggtcttttgtggaatatctcattgaagtagacttttaaccttgacttgctcaacatctgatcagaagcagctcgttgtcatataaggaaatctgctctgttatggaacatctttgagtagttgagttcccctttttcccataagtccaaatttgattccctgtcaccttcaattgttctttaacttgtttttaaacaaaagtctccctaaaaataattccagaagtatttgaactttatttctctattagcttctactgtaattaacatgaaaacaaacatgttttaaagtctttgtttccttctaaggtataatttagctttatcacgtcttcatagtgaaagttgtatacgtgaacgttggtaggatagaaaaactttccacatagttttatacttggtgcccagaaaacttccaaagtgtttaggtactactcattattatttcttagaaattgaatagaagcagtggcttgagtatacacagtcccactttttcgttaataataaccacatttccctttttttttttgcacaaaagtgttacatgtattttctcgtttaatccttgtacaacctattagggtaggtattttcctcatttggcagatgagggtgctgaggctcagagagatgaaagacctttcctgtcacacagctattaagggcagagctaggatttaaactcagatctaattctaaaacctgtatatttaactagtttgcacatctgtctccctgacttaattgcatcataaaatcaaagatatttctcttcaaaatatgttcatgttggattatttggctgtttcactgttagaggtctgttgcttctgctggcttttctgtggcaatcccagctgctcttccccgtggcttgggcacaccaaggatttcctttctgtgattgccccatatctccctagtccgctgtggggggcaccttcctgcttctgaggaaactgaagcaggagatgaggaaagggtaacaattaattacatacttttttttcccgagtattatcaactaacatgttccataaaggagcatgttttcacagctgtgtgctttagaaacagggagaaaggtttgagtttttatgactgaggtatcttcaacaaaggctgtgatgtacacgcttgatggacttggaacgtggaaacccattccctccctcagccctgggattggaatctttgtgtttatggtcacatgagtattcagatatgttatctctgaatgtgatgccctggtcagagaaccaaggagtggacttgctagattatatgatttaattaccctagatcaatcaagctttgacttactgatggcaggatatattgtgtattttttcctagttgctagaggaaaggaacaaagtttaatccttggctttgttgacctttggtatcacttttatcttgtagttccgtataactgcctttgtagactcttcaaaaggctgaaggcaagtgatttatagataagggctcattcagtacttgcacaagaagagcccatatcttcaaatatgggtgacgtaaatttacttcagaaacagaaatgagctcatttatttggagagatgtgaacagaatgtgcgtcttttgctccgggtgagaaataaatttaaattcagaactttgcttgggggaaatgaaatggaggaactaggcacttgagcctcttggaaattagagatctttagccaaggcccaagggagcactgtcttggtccatttataacaaaatactggagactgggtaatttataaagaacagaaatttatttctcactgttctggaggctgggaagttcaagattaaggtttgttgagtgctgcgtcttctagagtggatgaacactctgccctcaactggcagaaggagaatgggcaaaaaacaggagtaactcccctgctgagcccttttgtaagggcagctaatcccatttacccagagaggagccctcatggcctaaccacctcttaaaagccccacctcctattactgtcattggcaacacctgcattttggaagggacccattcaaaccatagcaagcaccaatagtatgtttcagaactcatccacataggagcactcctcagcatgtccaacagcagtctgtggagaactacttttttgttttggtttggttttttgttttcttttttgtgacacagtctctgttgcccaggctggaatgcagtggcatcatctcagcccactgaaatctctgcctcctgggttcaagtgattctcctgcctcagcctcccaagtagctgggattacaggtgcccgccaccacacctggctaatttttttgtatttttattacagatgggctttcaccatgttggccaggctggtctcaaactcctggcctcaagtgatccacccacctcggcctcctaaagtgctggcattacaggcatgagccaccgcgcccggccagagaactactttgtgtaagtctacgaggcaccatacacactttttcccttaaggaccttactgagtaactgggaagagagagcaggaatgtcaacaataatacagaagaagggttctatggtaaatgccgaaagtgaaccttcaacgaagtgagttccagagagacaacccataaaggtaaagatttagtcataaatgagctgtgttgctactgaaaacatcttgattctaaagtataaccacatctcaaccaagcaaaaactgtcttaagcctgaattaagaggaaaatgatattttaaatgaactcctcaagtaagttgccaaatcattgacactagaattttaagaattggtgactctagagctttcatggtttggctactgtattatctccctcaaggtgcagtaatatttctgtcaccaaaaatcattaattgataacattattctttctgttagttctagcacttatttccatcactgtgatttttttattatgatgattatttttactttacttacttagtataggggattacctgccttttaatgtcatcctgacaattaagacaaaatacagaacatgcttagcacagtgcttggctgagagagtgccatcattaatattaggcattatttttcttattcttgaaatacagtgttttatatagtgcctggcatgtagttaaattttagtaaattataataatgttgtttattgttttccaaaggatttttaacatgtattatcaattaatactctgagctacattcaaggtatatagtgctattcctcttttactaatacagaaactgaagttaagtacattggtcagatttttctggctgatttaagcagataaagaaattattaaaaggaatgtggatagctcacagaatcagcagaagagctctagaatcgtgttttgggctacctagccaagtaaaatggccaagatcatgccacagaactgagccactgccaagtacctgccgtgccttgcacggcaaacaatgctggctggcattggtgaccggactttgccacagggattgcttctactgctcccttggaaactgttttacagaaactgctgtcaccaaggaatgtacttcatggaaggccctattttgcaacatttgccccctatttacagtctggagtgggtggcaatttgctttattgccaactcattgtgtcttaactctctgtgaaagaaatacttcgtttatattttcttttaattggatataaactgagtagaagttgagattattttccttattagtagacttcgtgtgtggaaaagttagttttttctgaaattgatcttgttcttagcaattatctgctataagtattgcctcaactttttaggctactactaaatgagaactttccatctgatcagggcgtcttctccagtgtaaacaatcctgtttcccattacccattggagctaaggaacccatgatgagttaacacgtgcaagaagggttacccctttgagcaagaaaagtcctggcattagtatttcagatttttttcttgcatccttttctgatattttatttattttcatttaaagtggacctatggtttatcttgctgaaaatctcaaaaaaccaaaaaacaaacaaacaaaaaaaaaacgtgtcaggtccctaatgtgattgctgttaaccatataaaaataacctcccctcttttataatcagtcttggtgcgccttgcaaagcctacatttctaacctgtgtatacttcaaactactgtgagcatgtgttaaacacctttttttttttaaataaaaagaacactttcagctccttaaagcaagctcttttgggaaggaaagaatccctgagtgctgcagccatccatcctgctttgtctggaaagctaaggtttttgggttattgatgtttcaacaagtggagagcacctaggtctggtgagcaccagctgctgaagtgtggggggcacccaagtggcctgttcttccaggatggcattcattcttccaggcaagtgggacaaagtgggctttctgccttcactcagtgagagctgttgaaagattttctcatctgaattgtgaatgtttgtaatgtttattttcacagtaagagtgagggccttctcactttgaatatattcctttttgcaaataattttgaagtagtcctgatcctgtgttaaaagaaacatggtatgtcattatagaagaatccttcatcccccttcccttacaaacataaaattttcagagtttacatttggaagaaaacctggttcaattctctccattttcagggaaggaaatggaatttattctttcctttgtttatccttttatagttttcattttgttccctgttggtcacatttttttttttggccttcttattagaggggtattgtggaatatttttgcttagcaaaaattaaaatcaacatacctgactttgtaattgtaaaatatgtataacatacaatttatcattttaatcctttttgagtgtacaattcagtggcattaagtatattcacattgttgtgcagtatcatgaccttccatctccggaacttctccgttatcccaaattgaagtctattaaatagtaatttcccaatctctaccctcagccctgacaaacattattattctacttattttcgccatgaattttactattctttttgtttttttttttttttgagacagggcctcacgctgtcacccaggctagagtgcagtggcacgatcttggctcactgcgacctccctctaccttacaggctcaagtgatcctcccgcctcagcctcctgagtagctgggacctcaggtgcacaccaccacgcctggctaatttttgtatattttgtagagacggggtttcaccatgttgcccaggctggtctcaaactcctaggctcaagggatccttccacctcggcctcccaaatgctggggttacaggtgtgagccaccgcgcctggccaaatattactattctgtatgtttcttgtaaattgaatcatacagtttttgtccttttgtgtctggcatacttcagtttaccacaattttttcaggttccatctgtattctagcatgtaccagaatttcattctcttttttaaggctgaattctattatgtgtatataccacattttgtttatcctttcatccattgatggacatttgggttgtttctactttggccattgtgaataatgctgctgtgaacattgatacataaatatctgtatgagtccctgctttcagttcttttgggtgcatacccagaggtggaattgctgggtcatgtggtaattctatgtttattttttttcctcccttgtaattacccacaatgtggtaaaatacacttgacatgaaatttaccactgtaactatttttaagtataagttcagtggtattaagtacattgagattgttgtgtgaccatcaccactgtccatttcctgaatgtttttcatcttgcaaacctgaaactctatatccgttaaacagcaacttcctatcctctcttcctcccagccctggtaaccactgttctactttctttctctatgattttgacttttctgtgtacttcatataaatggaatcattcagtgtttgcttgtgactggcttacttcacttagtgtaatgtcctcaagattcacccatgttgttgcataggtcagaattttcttttaaaggctgaataccacatgtgtatatatatagaaaaatattattcagtcttaaaagggaattcctttttaaggaatgcctcattttgcttatccattcttctattgatggaaatttgaattgtttccatgttttggctattgtaaatcatgttctttgaaaatgagtgtacaaatgtctctttgagaccctgcttttgattcttttgggtatatactcagaagtggaattgctggatcatatagtaattttacatttaattttttgaggaaccaccacacccctttcgccagcggctatgctataccatgttacgtctccaccaatagtgagtaagggttctacatctttgccatcatttttttttgtttgtttttgatactagccatcttaatgggtgtgagggggcatctcattttagttttgaattgcccttccctaatgattagggatgtcaggaattctttttatctatttatttattttttattttattattattatactttaagttttagggtacatgtgcacaacgtgcaggtttgttacatatgtatacatgtgccatgttggtgtgctgtacccattaactcgtcatttagcattaggtatatctccaaatgctatccctccctcctccccccaccccacaacagtccccggtgtgtgatgtttcccttcctgtgtccatgaacacatggacacttattgttcaattcccacctgtgagtgagaacatatggtgtttggttttttgtccttgcaatagtttgctgagaatgatggtttccagcttcatccatgtccctacaaaggacatgaactcatcattttttatggctgcatagtattccatggtatatatgtgccacattttcttaatccagtctatcattgttggacatttgggttggttccaagtctttgctattgtgaatagtgctgcaataaacatacgtgttcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaccctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttttgagaagtgtctgttcatatccttcacccactttttgatggggttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacattgaagtctttaatccatcttgaattagtttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagtatgatgcctccagctttgttcttttggcttaggattgacttggcaacacgggctcttttttggttccatatgaactttcaagtagttttttccaattctgtgaagaaagtcattggtagcttgatggggatggcattgaatctataaattaccttgggcagtatggccattttcatgatactgattcttcctacccatgagcatggaatgttcttccatttgtttgtgtgttcttttattttattgagcagtggtttgtacttctccttgaagaggtccttcacatccctttaagttggatccctaggtattttattctctttgaaggaattgtgaatgggagttcattcatgatttagctctgtttgtctgttattggtgtataggaatgcttatgatttttgcacatggattttgtaccctgagactttgctgaagttgcttatcagcttaaggaggttttgggctgagaccatggggttttctagatatacaatcatgtcatctgcaaacagggacaatttgacttcctcttttcctaactgaatgcccttgatttccttctcctgcctgattgccctggccggaacttccaacactatgttgaataggagtggtgagagagggcatccctgtcttgtgcccgttttcaaagggaatgcttccagtttttgtccattccgtatcacattggttctttcatgtgcttattggccatttgtatctcttatttggagaaatgtcggttcaagtcctttgcccatttatgaattgggttgtttgaggttttttgttgggttttaggaattctctatatattctggatataatatacatgtatataataaatgtatataataaaatatacatgatttgaaagtattttctgcattttgtgggctgcctttttactctgttgatagtatcttttcatgcataaagttttaaaattttcattgtccaatctatctttttttgttgttgccagtgcctttggtgtcatacttaaaacattgttgcccaattcagtgtcatgaaacttttgcctgcgttttctcactataggaaactatagtaaaaaacattaaacgttttattgttttagatcttacatttaggtcatggattcattgttaattaacttttgtatatggtagtaggtaagggtccaacctcattcttttgcatgtggatagccagctttcctagcagcatttgttgaaaaaactgtcctttcccaactgaatggtcttggtgcccccaacaatcatatgactttatatgtgagggtttgttctgggccctctgctcatttctgtggtccatttgtctgtctttatgtcaatgctgcactgttttgattactgtaattttaagttttgaaatcaggaagagtgagtcctccagctttgttcttcttttcaggattgttttggctattcaggatctcttgagattccatatgaatttttggatggatctttctatttctgaaaaaaagtcactgggattttgatagggattgcattgaacctgtaaatcacttttggtaatattgacatcttaatattaaatcttccaatcaatgactatggggtgtcttaacatttgtatgtgtcctctttaattcctttcagctgtattttatggttttttttattgtacaagtctttcatctccttggttaagtttattcctaagtgttttattctttttgatgctattggaaatggaattgttttcttaatttcctttttggattgttcattagtgaatagaaatgcaactgatttttgcatgttgactttgtatcctgccactttggtgaatttatttatttattagttctgatagtatttttgtggaacattcaggttttctatatatgagatcatatcatccgtgaacagacataatttaacttctttctttctaatttcgatgccttttatttcttctcttgtcttattgctcttgacagaacttccattattatgttgaatagaagtggtgaaaacaggcatccttgctttattcctgatcttagagggaaagctttcaggtcatcaccattgaatatgaagtttgcttgcatttcttttatatggcttttattatgttgaggtagtctccttccattccttgtttgttgagtgttttatttgtttgtttttatcaagaaagggtgttgaattttctcaaatgctttctctgcatcagttgaaatgattttgtggttttctttttttttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattggggattggtgatgactctttttttttttttttttttattgatcattcttgggtgtttctcgcagagggggatttggcagggtcataggacaatagtggagggaaggtctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacctccatccacacagacccggcaaccatctgatttctcagttttttccccacccttcctgcctttctattccacaaaaccgccattgtcatcatggcccatccccaatgagccgctgggcacacctcccagacgggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctcctcacttcccagtaggggcggccgggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggccgggcagaggggtcctcacttcccagtaggggcggccgggcagaggcccccctcacctcctggacggggcggctggccaggcggggggctgatccccccacatccctcccggacggggcggctggccgggcggggggctgaccccccccacctccctcctggacggggcggctggccgggcggggggctgacccccccacctccctcccggatggggcggctggccaggcggggggctgacccccccacctccctcccggacggggcggctggccgggcagaggggctcctcacttcccagtaggggcggccaggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggctgggcagaggggctcctcacttcccagtaggggcggccgggcagaggagcccctcacctcccagactgggcggctggccgggcggggggctgacccccccacctccctcctggacggggcgactggctgggcagaggggctcctcacttcccagtaggggcggccgggcagaggagcccctcacctcccggacggggcggctggccgggcggggggctgaccccccccacctccctcccggatggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgtggccagcagaggcgctcctcacatcccagacagggcggcggggcagaggtgctccccacatctcagacgatgggcggccgggcagagacgctcctcacttcctagatgggatgggggtggggaagaggcgctcctcgcttcctagatgggatggcggccgggcggagacgctcctcactttccagactgggcagccaggcagagaggctcctcatatcccagacgatggggggccaggcagagacgctcctcacttcccagacggggtggcggctgggcagaggctgcaatctcggcactttgggggtccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcggcgtgcgcctgcaatcgcaggcactcggcaggctgaggcaggagaatcaggcagggaggttgcagtgagccgagatggcagcagtactgtccagctttggctcggcatcagagggagaccgtggaaggagaccgtggagagagggggagggggagggggaggggcgattttgtggttttcttccctttagtcttctaatataggctgttacgtggattgattttcgtgtgttgaatcatccttgtgttccaggaataaatctcacttggtcatggtgtataatccttttatatgctcctgaatttggtttactaggattttgtttgggatttttgcatcaatgtttgtaaggtaaattggtctacagttttcttttcttgtagtgtttttgtcttgctttggaatcagggtaatgctgccctcatagatgagttagggagtgttttctctgcttcaattttttgggaaagtctaaaaagggtttatgttagttcttttaaatggttggtggaactcacctgtgaaactatcagttccagggcttttctttatcaggagatttttttattatgtattcaatctccttactaattataggtctattcagagtttctatgtggcttagccttggtaggttctagttctgtgtttctaggaatttgtccatttcacctaggttatctaatttattgctgtacaattactcatagtaccttgtaaagtcatttttattcccatagaatcggtattaatgtacacactttctcgttttagtatttgagttgtctctcttttttcttagttcctctactctagcaaaaggtttgtcaattttgtttatctttttaaagaatcaacttttggtgctggtgattttctctatttttttttctattctctattttatttatctttggtctaatctttcttatttctatccttctgctaactttgggtttagtttgtttttctagttccttaagttgtaaagttagattgctggtgtgagatctttctttttattttttattttattttattttttagagatgggtatcactctgttgccaaggctagagtgcagtggtgcaatcatagctcattgtagcctcgaactcctggactcaagtgattcttctacctcagcctcccagtaactgagactacagacacacaccattatgcctggctaatttttaatttttatttatttacttatttttttaaagagacagagtctcactaggttgcccaagctcttctcgaactcctgggctcaagcgatccttccacctccgcctactgagtagatgggattatagatttgagtcaccgcacccaactcttgttttttaatgtaaacttttttttttttttttttttgagatggagtcttgctttgttgcccaggctggagtgcagtggcacagtctcagctcactgcagcctctgcctctcgggttcaagcaattctcctgcctcagcctccagagcagctgggattacaggcaggcgccaccatgcctggctactttttgtattttttttttttttagtagaggtggtgtttcaccatgttggccaggctggtcttgaacacttgacctcaagtgatccacccgccttggcctcccaaagtgctgggattacaggtgtgagtcatcctgcccagcctaatgtaaacattgataaatttcccccttagcattgctttcactgcatttcataagttttggtatattgtgtttttgttttaattcacctttaggtttttttcagtgtcctttgtgttttcttcattgatctgttggttgttttagtatgttctttaccgtccacaaattgtggattttccagtttttcttctgttgtagatttctaacttcattctattgtggtggaagaagattctttgtataatatctatcttttgaaatcttttgagacttaatctgtgacctaacatatggcctatcctgaaaaatgtcccatgtacacttgagaagaatgtgtattctgttgttaggtacattattctgtctgtctgtgaagttgagtcagtttgttgtgtgttcaagtcctctactttattacttatcttctgtttggtggttctagtcattattgtgagtgggatattgagacttccagctattattgaagtatttttcccttcaattttgtcagtgtttgcttgacaaattttgatggtctctcattaggtgtataaatgtttataatttttaaatctttttttgagacagggtctaactctgtcacccaggctgcagtgcagtagcgagatcttggctcactgcaacctctgcctcctcattgatcctccatctcagcctcctgagtaggtaggactagtaccatcatacccagttaatttttatatttttagtagagatggggtttcaccatgttggctgggctggtctcgaactcctgagctcaagcagtccacctgccttagcctctcacagtgctgggagtacaggcatgagccaccacacttgatttgaatatttataattctttttttttatcttcttgctatatcaaaccatttatttatttatttatttatttatttatttatttatttatttatttatttttgagacggagcctcactctgtcgcccaggctggagtgcagtgacgcaatctcagctcactgcaaggtctgcctcccaggttcacaccattttcctgcctcagcttcctgagtagctgggactataggtgcctgccgccatgcctggctaattttttttttgtttttttttttgtttttttagtggagatggggtttcactgtgttgccaggatggtctcaatctcctgacctcgtgatctgcccaccttggcctcccaaagtgctgagattacaggcgtgagccaccacacccggcctgaaccttttattaatatatgatgtcctttgtctcttgtaaccgctttcagtttaaggtctattttggtcagctacagtaactcactcctataatcccagcactttgagaggctgagacaggaggatcacttgaggcagaagtttgagactagcctgggcaacatagttagacccccatctctacaaaaaaatttaaaaattagccaggtgtgatagcgcatgtctgtagtcccagctacttgggagtctaaggcaggaggattgtttgagcccaggaattcgaagatacagtgagctatcatcatgccattgcactacagcctgggtaacagcgtgagactctctttcagtatagctcttttggttactatttggatgaatatctttttcatccattttcagcctgtttgtgtatttagatgtaaattgagtctctagtagacaagcatatagttggatcaggtttttaatccattctgtcaatccctgtcttttgattggagagtttaatccatatacatttaaagtacttaactgatacagtggcacttacttctgtcattttgctattagttttctagatgccttatagcttttttttgtttgtcattttctgtattgctgtcgtcttctgtgttgattttttgcagtgaaacatttatattcctttctcattcccttttgtgtatgttatatagctgttttctttttttaaaattattatactttaagttctagggtacatgtgcacaaagtgtaggtttgataaataggtatatatgtgccatgttggtttgctgcacccaccaactcgtcatttacattagatatttctcctaatgctatccctccgccagctcctcactccctgacaggccccggtgtatgatgttccccgccctgtgtccaagtgatctcattgttcagttcctacctatgagtgagaacatgcagtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctgttgtgaatagtgccataataaacatatgtgtgcatgtgtctttatagcagcatgatttataatcctttgggtatatacccagtaatgggatggctgggtcaaatgttatttctagttctagatccttgaggaattgccacattgtcttccacaatggttggactaaattacactcccaccaacggtgtaaaagtgttcctgtttctccgcatcctctccagcacatgttgtttcatgactttttaatgattgccattctaattggcatgagatggtatctcattgtggttttgattcgcatttctctgatgaccagtgatgatgagcattttttcatgtgttttttggcagcttagatgtcttcttttgaggagtgtctgttcatatcttttgcccacttgttgatggggttgtttgtttttttcttgtaaatttgtttgaattctttgtagattttggacattagctctttgtctgatggatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccattttgaattaatttttgtataaggtgtaaggaagggatccagtttcagctttctacatatggctagccagttttcccagcactatttattaaatagggaatcctttccccatttcttgtttttatcaggtttgtcaaaaatcagatggttgtagatgtgtggtgttatttctgagggctctgttctgttccattggtctatatctctgttttggtaccagtaccatgctgttttggttactgtagccttgtagtatagttgaagtcaggtagtatgatgcctccagctttgttctttttgcttaggattgtcttggcaatgcgggctcttttttggttccatatgaactttcaagtagttttttccaattctgtgaagaaagtcattggtagcttaatggggatggcattgaatctataaattactttgggcagtatggccattttcatgatattgattctttgtatccgtgagcatggaatattcttccatttgtttgtgtcctcttttatctcgttatttcatcgagcagtggtttatagctctccttgaagaggtacttcacatcccttgtaagttggatccctaggtattttattctctttgaagcaattgtgaatgggagttcactcataatttggctgtttgtctgttattggtgtataggaatgattgtgatttttgcacactgattttgtatcctgagactttgctgaagttgcttatcagcttaaggagatttggggctgagatgatggagttttctaaatatacaatcatgtcatctgcaaacagggacaatttgacttcctcatttcctaattgaatatcctttatttctttttcttgcctgattgccctggccagaacttccaacactgtgttgaataggagtggtgagagggagcattcttgtcttgtgccgattttcaaagggaatgcttccagtttttgcccattcggtatgatactggctgtgggtttgtcattaatagctcttattattttgagatacgttccatcaatacccagtttattgagagtttttagcatgaagcgctgttgaattttgttgaaggccttttctgcatctattgagataatcatgtgttttttgtggtcggttctgtttatgtgatggattacgtttattgatttgtgtatgttgaaccagccttgcatcccagggatgaagccgacttgatcgtggtaggtaagctttttgatgtgctcctggattcggtttgccagtattttattgaggattttcgcatcgatgttcatcagggatattggtctaaaattctcttctttttgttatgtctctgccaggctttggtatcaggatgctgctggcctcataaaatgagttagggaggattccctctttttctattgattggaatagtttcagaaggaatggtaccagctcctctttgtacctctggtagaatttggctgtgaatccttctggttctggactttttttggttggtaggctattaattattgcctcaatttcagagcctattattggtgtattaagagattcatcttcttcctggtttagtcttgggagggggtatgtgtccaggaatttatccatttcttctagattttctagtttatttgtgtagaagtgtttatagtgttctctgatgatagtttgtatttctgtgggatcggtgatgatattccctttatcatttgttattgtgtctatttgattcttctctcttttcttctttgttagtcttgctagtggtttatcaattttgttgatcttttcaaaaaaccagctcctggactcattgattttttttaagggtttttatgtctctgtctctttcagttctgctctgatcttagttatttcttgccttctgctagcttttgaatttgtttgttcttgcttcttttaattgtgatattagggtgtcgattttagatctttcctgctttctcttgtgggcatttagtgcttatgctgttttctttgcacttatcatgaggattatatttaagatcctaacgtggtaacacaataatttgaatttataccagcttagctttcttttcttttatttttttttttaagtgaaaacaagtttattaagaaagtgaaggaggccggatgcggtggctcacgcatgtaactccagcactttggaaggcccaggcaggcagatcacctgaggtcaggcgttcaagaccagcctgaccaacatggtgaaaccccatctctactaaaaattcaaaaattagccaggcgtggtggcacatgcctgtagtctcagctacttggaagaatcgtttgaacccaggaggcagaggttgcagtgagccgagatcgtggcactgcactccagcctgggtaacagagtgagtcttcatctcaaaagaaaaaaaaaaagtaaaagaataaggaatgacctccagaggcagagcagtgacagcttaactttcataacatagaaaaactctgctcctttccagcttagtttccatccctttcagttgttaatgtcacaagataatatctttatacagggtgtgtccaaaatataaactaatacttttttaatgcagtaatctctcaaattatgtaaaaaaacaaaatatggagttataaactaaagttacaataacattagcttttagactaattttttttaatgtatcagtctcttaacgcagaaagccaaaagtggagctacaaaccatggttacaaaagagttacgaaccatggttacaaaaacccctgtaaatacatgggcttttttttttttattttttatttatttttttattttttgagatggagtctcactctgtcacctaggctggagtgcagtggcgtgatctcgactcactgcaagctccgcctcccggcttcacgccattctcctgcctcagcctcccaagtagctgggactaaaggcgcccgccaccacgcctggctaatttttttgtatttttagtagagacggggtcccaccgtgttagccaggatggtctcaatctcctgacctcgtgatccaccctccttggcatcccaaagtgctgggattacaggcatgaacagtacatgggcttttataatttgccatatatttacctttactgagatctttatttcttcactcaactctctagtgtgctttcatttcaacctgcaggaccccctttagcatttcttgcagggcaggtctagtattaagaaactccctcagcttttttttttttttttttttttttttttcctgactgatacgcttaatttctccctcatttttgaaggatagttttactggatataaaattcttggttgacaggttttttgttttttgtttttttttcttttagcagtttaccaccttatggccccctaggtttctgatgagaaatctgttgataatcttattaaggttcccttttatgtgataaggtgtttttcttttgctgctttcaaatttctcgttgtctttttgtttgttttttgagacagagtctcagtctgtcacccaggctagagtgcagtagtgcaatctcagctcactgcaacctctgcatcccaggctcagatgatcctcctgccttagcctcccaagtagctgggactacaggcatctgccaccacgcctggctaatttttatatttttttgtagagatggggttttgccatgttgcccaggctggtgtcaaactcctgacctcaagtgatctgcccaccttggcctcccaaagtgctgggattacaggcgtgagccagtgtgcctggccctttctaaaggttgattataatgtgtcctggtgtgggtctctgaatcctgttttgagtttgttgagcttcttggatgtttgtattcatctctttcatcaaatttgggatgtttttggccattgtttcttcagatgttttctctccctttctctttctgttttccttttgggactcccacaatgcatacggttatccacttgatggtgtctcatcaatcccttagatcagttcacttttccttaatcttttttctttctgttcctcagactagatagtattcattgtactcattattcactcattctttcttctgcctgctcaaatctgcctttgaatccctgcattgaatttttcgtatcagttatttcagttccagaacttatttttcatttctttttaggttttctgtctctttattgatattttccatttgtttatacattgttttcttggctttctccatgtctcctttagctctttgagcatctttaagacagttgttttaaagtctttgtctagtggatttgccattgtcttttttcagggacagtatctgttggtttatatttttcctttgaatgagccatacttttctgtttctttgtatgactggtgatttttttttttttgaaaattggacatttaaatccagtaatatggtaactgtggaaacagattctcccccttctctgggtttactgttttttgggtttatttttggtattttgattgttacaggatgtgtctgtgccaagaatcagccagaggtatacatgttaggtctcctcagatcttttctgagcctgtgctcttccctgggcatgcatagcaactttctaatttcccctatatatgtggttgcttttgaatatcctggtctttaatgtccgggtcccagagagggaaaaagaaaaaagtgaaggagggtgaaaaaaatgctgccccctttaatcctctgaaagtcacttcagcgtgagtgggaagaccttgcagcagtgtggtggaggtgcaacaacagtgattaccgtctgtgtctctgtctgcacctttgtgatcagaagcagccaacattgatcagagcatagattcatatttagaggacagggtccttttctcccctgctgtctcccacaaactgtgtgcaagccactccaggaataagtgcgtagctgcctgcagtggggatgggagctttgagatggctggtgctattatgatgacagctgaaatagactgaaagtaattataattcatcatccaggccttcctctggatgttgcaagccttcaatagactctagagctacaaaatagttacatcagacagagtgcaccagtgcaattatttagttgggaagataaattcctggtgcttcctaccacagtcttccccaaattccctttttagttactttttttaggaacccccatactgttttccccagcaggtgcaccattttacattgtcaccagcaatgcacaagggttccaaggatatggagaacatccttgccaacacttgttattttccattgtttggataatagccatcctaatgattaagtggtatctcattgtgttttgtatttccctcatgattagtgatgtcgagcatccttcatatgcttattggctgtttgtatatctcctttggagaaatgcctatttaaatcctttgcccaattgtgtggtttgttgttttatctttttaaatttagctccttttcatatttgccttccttataaataactcctgcttcttctggtaatctgcttgaggaatgagatcatttctttgctatttcctacagtgctagtacatagtagtgtgtgcctggtaaacacttatagtggtaggataggccagtcatacagccagcttttgaaagcctgcttaattgactactacagttggtgactggggactttgagacagtgaggaaattaacacgaattgtgtgcctcctctttgctaggtgctgtggtaggcataactttatatagttcccataatactcctttaatatgtcacacttacagatgaaggatttgaattaagggaagttaaatttagactccctcaacatcacacaggttttaaatggcaatccttggattccaattccgggtctacctgactccaaactttttcattataccatgtggtctcccttccctagtctggtaagttcaaacagagagcaagcctgcgaacctggaaattgtttagggcagatgagcagttgaacatttacttaataggagacagagaatcgtgctatattgccgaggctggctttgaacttctaggcttaagcagtcctctcacctctgcataccaagtagttggtaactacagcctattccattttacttaattattcaagaggaaaaggtagagattgtgaaatgctaattttatagcagtgaacaggattcctcgaagacactgaggtgtgtcgtttgtggatactgatgacctttggaaatactgtgtctacttttgggtgtgacatcctctgttcttgtttctttggtaccataaattagggccactggccatggccaaatgggtgcctaacacagaaggatgaagtgcttttcattgcttaccacaaattcccttgaaccctttacttctctgagacttaagaaatgcaagaataaagggaacagagttttatcaaaatcctattgtgtgctaggcaaaccctagaagggacatgattattatcttgcttttacatatgagaaaattgaggctcaaagatgtaagataaattgtccagattcacacagctaataaataagggagctgaattcagctttttccatgctgcctccattaaaaagttcctctgtcttgccctctggtgggtttcggaggtcctgggagaaatgtttgtatcctcaccaaacattgtggtgggtggcatcttacatggggcttgttctgcacttgcagtttcttctgccacatggtttaaccagagcaatgatgactgccgttgccccctcgaggttagcactcctctgaggtcacagggtggggataaatgttctgaaggaatcagccttagaaagcacactttttctaagtatcccgaaggaatcaatcactaacgcacatcacaaaattctctccaagttgggaagatggttttagactttctctttcttttctttttttttttttttttttttttttgaggtgggagtctcgcactctcgtccaggctggagtttggtggcacaatctcggctcactgcaagctccaccttccaggttcacgcctttcttctgcctcagcctcccaagtagctgggactacaggcacccgccaccacgcccagctaattttttgtatttttactagagatggggtttcaccgtgttagccaggatggtctcgatatcctgaccttgtgatgggcccgcctcggcctcccaaagtgctgggattacaggcgtgagccaccgcgcccggccagactttccctttctttaagaagagaagggagtgcctttgagaactagagtttaagtaaaggatacatatagcttaagtgcttttatctttgaaatatactatgaccaatagactcgaaaatttcttattgtttttgggggtatcatagtcaatttgggctcctataacagaataccataaaccgggtggcttaaacagcaagcatttatctctgatagttctggtggctgggaaatccaaggtcaaggtgccggcagatttgcctctgccgaggacctgctccctggtttgcagatggctatcttcttgctgtggcctcacatggctgggaacagaaagagtgaggggaggctctcacatctcttcttctagtgacactagtcccattcatgaagcctctatactcatgatctactcacccactaaggtccccacctcctaataccattacactggggattaggatttcaacataggaaatttggggaaacacaaacattcagtccatacgggggaattttcttttttcagaatctgttgtttaattataccttcacagtaacttttgtcaaagttatatttaatttctacttcctggattctgtagcagtaaatggagctcgttatgtgtcccaatatttgtaatactgatttctagtcctagaagtatctaagcctctcagagttaaggaattcggtttggtaataggctaagctaatagccatatggctctgcactgtgctatagagaaactgtgggtttccccccacctgacatctcagaatgaaaaagatcactctgcagaatatttcccacacttctaaccctgatgatttttccactcaacattttacacaaagaggtaggtacagatggtagtttgctggatctctggaatattcagtcttggtcttcactcactccctggagcctactcctcatttttgtataagcaaagtggtttaaacagggtcttaggaaatatctccagtatttaccatttgcaaacctaacccttaatatatggaatctgttagatcaggtttttaactcagtaaacatctttgggtgcatccccgtattaaactaaagaagaagtagaaaactgaaggcaatggccctgttgcttaactgtaaggaacatgtaatttagaaacttcttctctttaacatggaaaactaaccataagtatgtggatcaacgttcttctttatggagtattaggagtgaagtgtcatgatgttatggtgtttttaacggctcagcaaaagaaaaaaaattatatagtgagatgaagtagatatgacaaaatattagttgttgaatctaggtggtgggtatttgggtatacatttttcccctacttttctacatttaaaaattttcataataaagggtaaagcagaaaaatcctaagtgtaaaaaacatttataaaactatacaaaaaataatttcaaggttcattctctattaatggtattggagttggtaggaaataattaaaataggagtataaatccagaagcccgcagaggccaggcaggtaatgtgggtgagtggagctgccgggcattggacaggagggagatggtggggactgagcaaacaggcaagtgcacaactcattgaaagcattccaaaaatttaaaaaatcttaatgctcattcagaatgaaacacttcagaggactggaagtttgtggtctcctaaaaatgacaaaatttaccgtctctaaatttgcccagctttctgtccttctccctcttttcagaagatccaggagaggcgtagctatcaatacgagagggagatggtttcctggcacaagagggtgatgggaaaacattgtgttcaatgcctctagaatttgcctgggttgccacaactttgttgcttcaggaatggaaaatgtggcccatcttcttattttctctgtcctgtcttgctcctgctatgacccggggcaggatttgcggtgggtttatggagattcctatgagtcaaggaagcacattctgaggatagagtcatgcacctgggttttgtttttagatggttagagggaggctgcaattgtgatttataagaatgacttaaagtgtaattcctttgattttgaagttggctaggcaacttaatttgaacatcctagtgtgcctattagacctggcaaccttctcaaaatccccctcctacttccctcgtttccctcaccctccacctttttctcaagaggtagaagtgagagttttgttttgtgagctaaggttgggttctgggccctctgcttcagccacctggcagcttgggctggccctgtagccttcctccacttcattctgcgattcaggctcccaatagtcttctgaagcaccggagagcttcctcatgcaccttagaagagcagattcagactgagacaaggactcgctcttaggcatatatgcagcctacagagatcctgggaagcctttttcctcctaatatcttcctagacttatgctttccttggaattccagcaatagaactgcatactcgtaccctaatcaagaaccttttatgtactaggtgctctactagacatgagataaaaagataagcaaaacgtggtccctgtcttcaaccagctcaccatttgttataccactttaatcaccttagagaaaatttttttttttttttttgagacagagtcttgctctgtcacccaggctggagtgcagtggcaagatctcggctcactgcaagctctgcctcctgggttcacgccattctcctgcctcagcctcccgagtagctgggactacaggcgcctgccaccacgcctggctaatttttttatatttttagtagagacggggtttcaccatgttagccagggtggtctcgatctcctgacctcgtgattcgcctgccttggcctcccaaagtgctgggattacaggcgtgagccactgtgcctggccgataaaatgttttaagatgtgttcggccatatgaactttggtgagaattaaagatgaggtttttacttatggagtagggggcacttgggatgggtgaagaagggagaactgccctgaagttcttactcatagatgaggaaaaacctcagctttttgttaaaatgagtttatttatttaaaaaatatttaagggggaaatgcattcatttggttaaaaaaagttctgttaaaagtatactatgaaattccccctctttaccccttgcctccatctaattcttatatatcatttcagagtttatttatgtaaatataagtaaatctgaacatatactcttgtttacttgcaccccaacccccatttttatgcaatgatagcacactctatgcatctatataccttttaaaaattttatcttatggaggtttttttccatgtaagtacatagagagcgccctcattcttttctttgttcatgtaatactatttatagatataccctgatttaattaacaggccctctattcagggacattgtggtgtttgctgacctttgctgttacagtcactgctgcaatgaatactcttgtatatacatcatttagcttgtgtgctactgtgtgtgtaaattcctagtggtgaagctgttgcatcagaggctatgcatttgtaattttgttatccatgccaaattgccctcctccatagggtgttaacaacttacacactaagcagcaaaacctctttcctcacagctccacctacaaagtatttttcatgcttttcgtttttaccaatttgacaggtgaaaaatgggcttgtggtaaagtttcaatttgtttttcttattataagtgaggttgtgcatcttttcttatagttgaggtattggtatttccttttctgtgaaatatcttttcataacttttgttcatctttcttttgctaattcttttttttttttttttttgagacggagtcttgctctgtcggcaggctggagtgtggtggcatgatcgcggctcactgcaagctccgcctccgggttcaagcgattctcctgcctcagcctcctgagtagctgggaatacaggtgcctgccaccatgcccaactaatttttgtatttttagtagagacggggtttcaccatgttggccaggatggtcttgatctcttgacctcgtgatctgcccgcctcggcttcccaaagtgctgggattacaggcgtgagccactgcgcctggcccttttgctagtttttaatttgccaatttcttttcttgtttttttagagatggagttggatcttggctcacttcagcctttgcctcccgggttcgagagattcttctgcctcagcctctcaagtagctgggactacaggtgcatgccaccacacccacctactttttgtatttttagtagagatggggtttcaccgtgttagccaggctggtcttgaactcctgacctcaggtgatctgcccgcctcagcctcccaaagtgctggaattataggcatgagccactgtgcccagccttatttgcaatttctaggcactctttatatattaggaagtttaccctatgtgatatgagttatcacaataggaggaaaaaggcttcctggggtctctgcaggttttttattttcctcagattttgggtattctttttgtattttaaattttaacttgtgtttgttgtcatgaggagtcttggtttttgtattgttgaatttatcagtgtttcctttatggcttttgcattatcctggtccactgttaatggcacaaaatcgttcattcctttttccatggtgcctccttcctcttttcctctttcaatttcggattgacagcaaaatgcttttggtatcttctcccaagtttgcgttcctggaaatgtatttcttgtcagtgatagggtagcccttgatagttttgttaggagattttagtggtctgtagcattcccattttcttggtacaggcactctgggaaactgacagtttcttataaaactaaacatgcaattaccatatgacccagcaattgcattcttgggcatttatcccagagaaatgaaaacttatgtttacacaaaaacctgtacatgactgctcacagcagacttgtttgtaatagccccaaactggaaacagtccaaatgtcctccaatgggtgaatggtttaacaaactctgatacatatataccatggaatactactcagaaataaaaaaagaattaaccattgatatatcaacaacatagacacatctctaaagttttatgttgggcaactaaaaagattcaatcctaaaagcttacatcatgtattatttcatttatataacacttttgaaaggacaaaattttagaaatgttgaatggattaatggttgccagtgttttaaagatggaaagggggatgagagaaagagtggggtaggtatagttacaaaagcagcacaagaactctttgtggtgatggaacttttcagcatctgaccatggtgatgaatacatgaacttgtgtataggaaaaaaaactaaatacagacacaaatcagtgcaaataaaatgaggaaatctgggctgggcacagtggctcatgcctgtaatcccagcactttggaaggctgaggcagctggatcaccttaggtcaagagtttgagatcagcctggccaacatggtgaaaccctgtctctactaaaaaatgcaaaaattaggcaggaatggtggcacatgcctgtaatcccagctactcaggggccttgttcaattgcttgaacaaggtttcagtgagctgaggagatcattccactgtgctccagcctggaagacagagcgagactgtgtctcaaaaaaaaaaaaaaaaaaaaaaaaaaggaaatctgcccgggtgcagcggcatactcctgtagtcccagctacttgggaagccaaggtgggaggatctcttgagcttaggagtttgaggccagcctcagcaacagagggagataccatctctaaaccaaaaaagggagggatgggtaggatctgaataaggtcagattatatctatgtcaatatcctggttgtgatattgtaccatagttttacaagatgtttccattgagggaaattgggtaaaggggacacgggatcctatacataggatctcaataaaaatttcaattaaaaaattcccaatttctgctaatactggattcaccaaaacatactgcctggaagcaggttcaggtcaagtaactggtgctctcctgtgttaggacttgtagtgcagcagctgagcagtggaatgtggaggagcctagcagtgcctcgggttccagccctgtatgctgctctgtctcagaagatctgagagcatcgaccagcatttcccaggattctctgggacaacctagctgggtagcccttcatacagcctgtctggagggagagaatactggcttcagctctaatatatcagaacagtgtggtgtggatgttggtggttggggacagtgaggggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctcaaaaaaaaaaaaaaaaaaaaaaagctttgctgtgccctgcacgtgacctactgtcatatgtattctgtgttccttgtgctgtagcattggctctgctgtgagacagaatggtctggcatgtggtagggcgatcactgggatccccaagaccctgctagggaatctctgaggtcaaaactatgtttgtaataatacttagacattatttgcaaaacatgctcattctcttacagaagtgtccagtggagttttccagaggctaaatgatgtgaaatagcaacagattaaatgcagaagcagctatgatattccagctgttttctattaaggcagacattaaaaagacattaataaaaataaaccagtggcatcatttcacttttttggtttggaagaatattttccttaaaatgttatttttgttaatgtataaaggggttatcattatatttaaatgatttaatatttaagaatgttctcagttttaatttttataggtgaatatcaaaagataaaactcacataaaagctctttggggtccttggtaatttttgagagtgtagaggttctgataattgagaactgttgatttggcagaaagcaataggcttaatttctagactgggctttgctttgtgaatgtgggcatcatttggcctcttcaattgatttcttctcctgcaaatgctattaattgccctgctacatacctataaaaatataatcccctatgcaaatacaggggagattaatggttacctggctaagctggtgttgaaagaaaatgtaaagaatgagtttctggcctgttagctgacagtctgtttacttgttaaatgtctccattttagcatctcctagcagtttctgtatacatttgatttctttttctcagtttttcagacaaccattttaattatttttaaaaattatattcccacattttcaattaataagggatttatattcctagtaccttgaagtgatgtgataaggtcaggagctctgttcttggagaaaccacttactagctatgtgacgtttggaaagttacttaacttctctgtgtcttggcttcctcctgtgtaaatggagctaataatacctcactttccagggcagctgtgaatacgaaaaatcgtgcacaagaagcacttagcaaaagtgcttggcacataacagatgccccataaataataattgcaacgattgtcattaacatataacaaaagatgcaagattaaattgaagtcttaccctgtcttcagtgaacttgttaaactactttattcacaagtttattagcagtaattttaatttcatttcatttttttctcctttgaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagaggtaatgtgctgcgggaaaataacattgctgactggttgttgtgattctctgcaactctggatgccatcttaagacttgacatttgtcactattgctttgaggagattgctttttcccagcagtaaaatgtgatgatgaaaaaagtggtccacagagctgggctaatttagagtttgaattctgatcaccactgatttgcttggccaagttgcttaacttctctgtctcagtttcctcatgtgaaaaatggggctaatagtagtaacttaccccaagggttgagtgacagattgcttagtaagtgttagctattattagtgcatgtaaagtcctgccatactaatttgctctagccaccattctgtctttgaattgactttaattgtttcctgtgtataatttatattttgtttcccagtagattaaaatttctttcaaagcaggagctttgatacgaaaagctccagtgattcttaatggttttatggaaacaattacgcctatttaacccgcaaagtttttaaaggaaagaagcaatgtaattcatgtgaaagtacttagtaaactgaagcacatgatgcaaatgttgtgtaattatcaatctcagtaaataggtacttcctttaagcacttaaatgtatcattgaccagctgctgcacagcacagttctaggggcataaaggaataagtaagtacattttccaaagtttccagtcaagaaaaactttatattcctgataccttgatgtactgtaatatcaaggaaatgttaggagctgtttactggagaaaccacttctgtgaatggcactcccagatttgtttaacaaagtggccctttaactctggtgagagaagatggacatggagaaacaagtgatggagcaagaatcactgcagattaacaatttgtatttagcaatggaggtagtgtatccttgagattacaaagcagtcattagttatattgacagatttaaatttgccaacacctccaacattttagtgcttagctttcataaaatgttgcatgcatatactcttctctcatgggttaaatactattatttggaaaactattaaacatgacctttgatattgcttttcattgatgtggctttgcaaatattataaacttattttactatattatggtctaccaagctttactttccaaacatgactattcattggcatcatgtgagttttttgtttgttttaatactgagttctcccctcctcccagtaagtctaggtgtggtctgtgaatcattattttaataagatgttatggtttggctgtgtccctacccaaatctcctcttgaattgtagcttccataattcccacatgtcatgggagggacccagtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgtgattgtgatgcctccccagccatgtggaactgtgagtcaactaaacctctttcctttataaattacccagtcttggatatgtctttattagcaatgtgagaacagactaatacataagtttaccaaatgatacaatgccaccctctattacccaggatttgggaaccagtggtcttaagcactatttctaaaataagttctacaaaactagtcccatataaagaggtcaaacgatttgcatattccctcaccaccccttggaaagtcacaaagcgtattatctcacttaaagttcttaggagtctcacaataaagaaagccagacttttgaaacttagttgacctcagaacacttatcttaggtaacatttattaatgtcccataaagtagtgattttagaacattctttgggaaatgctattgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtcctttaagttcaagaccagcctggccaacatggtgaaactccatctctactaaaaatacaaaaattagccaggtgtgatggtgcatgcctgtagtcccagctcctcgggaggctgaggcacaagaatcgcttgaacctgggaggtggaggttacagtgagcccagatcatgtcactgcactccaaccagggcgacagagccagatttcatctcaaaaaaaaaaaaaaaaaaaacgaaaaacaacaacaaaaacctctaatccatatctgttgttttgcagtttagtaaagtgtggtacggagagattaactgactagctctatatcagagagctggggaaagtgttttgtagctggaagtaccagacagagcttctcattatagcacattttcaagacttcagagcagtgtttgtcagccctggttacatgttaaaattactcggaagttttttcctccaatatatatgatgggaaattttacacatatactgaagaagacagggtaaaagaaggcggagtaacacagtgaaccttaatgtactcattaccagccactacaatcatcagcttgcaaatactcctgttttatccatatccccactccctgccaccctcaactgtatattttatagtaaatccccagacattatttcattcataaatatttaagtatatatctttaaaagtgaaggattcttttaaaaaataacttttaaatttgaattaattttagacttggaggaaagtcacagaaataatttgagagtacctatataccctgccccatgcagcttcccctaaagttaacactttacataaccttcgtacaatgatcaaaaccaggaaattagcttggtacaatactagcaattaaatggaggccttattttgaattttaccagtaattccacgaatgaatgactgagtcgttttgaaagatgtagttataatgctgttatacctaaaatatttaacaatgataccttaattcattcagcatagctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatggctcatgcctgtaatcccagcactttcggaggccaaggcaggtggattgtttgagcccaggagttcaagaccagcctgggcaacatggtgaaaccccatctctacaaaaaagaccaagaaaaaaaacaaacaggcatggtggtgcgtgcctgtagtcccagctacttgggaggtgagaagatggtttgagctcaggaggcagaggttgcggtgagccgagatctccactccagtctgggctacagagcaagaccctgtctcaaaaaataaaataaacagtttaaaattctgtttgaagaactttgggattcactttgaatagtcagtaattacccaggattattgcaaaacagagaccagcactcacagtactgagcaatacctcagcagcgtgctcgggcagaggaggtgagtgcagttttggggctttcattggtggcgtaatgtgtccgtcttatctctgttggtgagtgttagcaaactcctgaatcatatccgtccgtctatgttcacctcagacctaagggttgaaattagtcacttccaaatgagtaaagcagaggatgtcattttgatcaaacaccaactctctgatattattccagatgtttcctggaaatttggttggaaagatgaggaagtaacataatgctatgtgttgacaagtgagggaacttaataaccatggagaatatgtgttagtggaagtatataaccgggatcaactagaggtccctaagattacagtacctgtgatcacttaagtctggatcaaagggaaacatggctataactatttctgattcagataaaggaaaatcagagagttagctcagctttccttatgttaaatttggatgatgctcttgaatgaaaagcttatgtttatagatttgtgtatgtgagggagaagaacggaggtaatttactttgcaatcagggagtctagtgacataccttaactactagtttctttaatggcgataggctgacccctcagccagcactgttgagcagctattgcagacccacctagtggggaggtcctttgggggttccagagacatgtaacatggtccttgctctttgagagtttagcctcgctgagggaatgaagatatacagaacagaaatatgaaaaaggcactgttgaaggggaatgctcatttgttatttataactaaagttctgtaagagttaaagattgggatatcctggagcagacggggtttaagctaggtctttgaaaaaaaaaaaaaaaccaggatttgggaaatgagaggaagaggggggcattgctgcaggggaacagcttgacagtcttagaagaaaattaactttggggcttcagggacactgaagaaactggcctgagtttcagtgagcttgctcagagaaatctctgcattaagaaccacagaatgttggaattggaaggaccttagagaccctctggtccagtgctctcattattcagatgcagaaattaaaggcttttacagaaagtaagcacttcgcccaggtcacacagtgaggtagtggccaaaattaagttaaaagtggatgaagatcaaaggggattttttgttatgcaggtggtgcacttgaacatgtttacaggatgagggggaagaggcagatgagacaagatcaaagatgaaggagaaagggggattcttagagcaagatccctgaggaggcaagagttggagccttgtgggacatctgttctgagagaacagggaggacgcaggcaagtttatgacaggagggtccctggcacagatcggtcacacccagcagcttgtatcctctgtggagaagagggaggtcatttgttgagtggtcatggtgactgggtacagtaatgagtgccattaggcattgagggctcagctgaggcagggcaacttgtatttgctctttgtatttgcagacaatttggcagaatggttctgagcgtaaactccagagccacactgccaaggttcaatcctggctccatctctgactacctgtgtgacctcaggcaagtcccttaattcttctgagcctcagtttccttttctgttcagtgagaacagaatgacatccacctcaggttttcgtgagggttcaatgagttattcttggtacagttctagggaccacgcctgccatgtagtagacactgtagtgttagctctttgttattgctttaaatataaatgatgactaaggagaaaggcctatcctaattgccatgaattggcccatttgaaattacttgataccagcagctgtctaaatattgccccattttaagttctgctcttaacaacccaagtataagcactaaatagaggcaaggcaaaaaaaaaatttttttttttttaagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaatacgcagccccaggaagatgcagcacagacttttggagcttctcttgtcacttccctgggtcttacttctgcctcattctagttgctgtcagtgggtaaatgtgttcatagattagaacaagttgcagcacagacttttggagcttctcttgtcactgccctgggtcttatttctgcctcattctagttgctgtcagtgggtaaatgtgtcatagattagaacgcctttgtaactaagataaagccacaagctttattttgttacagttcctgtgtgcttgcttgaaggccttgagagtacattcatgatatgattctagtaactcctgttttaattcttagatgtgttgataagcatagtgtattgacataaaccagtatgaagcatggagggggttcagatgaactggtaagaaaaacttgcaatccttggaaagccatatgattacacaggattatgaagaggccctaaggtttctctaatttagccctttcattgtgcaaataaagaaaccaaggatcttcgagtgtatatgggatttgctgggtatctttccattagataatgactaagatggtattagaaggtgagtcatcttttccactgcaccatactacttatgttctgcctctttggagtccttcatttcatttttggttattcctttttttacatggtaggtcctcaactggtgtttgaaggaatgcacgagagttgccattcatgggcctgcacacagggctgggcagggatttctttctgtcatcggtaccgtaatgtttaagacccagctggagtcattttccaagtatttgacctgacttcctgtactgtgtgtcctcccagggagagagactgatccagattaaatgagtagttccgagtgttgcacagagcatcactgtctgaactggcattagcattcactttgagctcctttggttaaaagcctggttagcgtgagctgttggccaggtgaaactgttgctatcgccctgacactgtgaaccgaatctcctttaaatgacaacattgttagagtcctgtggccgcttttaaatatattttggcttcagttgcttctttcttgacctgaaattataaaatgagttgggagtacctattgcaaagctgcaaattttgacaagaacattgagatgtcggcttctttttgctgaaatcctgaggcaagacatttcaagaaaattttatgttcccatagaatgtcacaagttactctggcatcaattccaggttgaaaccttacagtgtaattatagtttccccccttcttgtcctttgggcaacctttcttttctgtaagaaatacaactggtcccctgggtggcaggaaatccaggtgggggagtgggctgcttctggttcggcggactgtaaggtatgctgcacagggcttccttgggcctggccccacacttcctttgcaccagcactgtcctgccaaaagccagaaatcctggaagagggccgaatctagtttattacttgcctgttggaaatgtaggcttgtgttttttggcaaggcatgagcagagcccggttatttgactgctctgagatttaactccattccgcttttggacaatgacatatgagcatgtgtgaacagcagccccatttccccccagtttgcctgccctagacatgccctcagacagctggctctgccagctttcccagtgccaggttctagagcccctgttcttctccctcccctgctcatttccagtccaccagagcgggcagtgtcagaggtcccatgcagcctcctctcttgtgaggaaccccagagcacctgtagtctctaagccaactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccaccttgctgatagtgtccagtggcaaaagggaaaaaagagtggactagcacagttaggaggttcttacgggccaaacctatgagtgttgcctatgacttcggctagaactcaattacatggccacagctaactccaaagaggctgggaaatacagtctattgtgtgcccaggggtacactaaattttgaacatctgtgtcatcttcgaacttagattcctaaaatgcatctgcagcccagctttgagattcagaaggcctgatgcaaggttccatggtaaattttgcttggtttaagtcctcctgccaatgaaaaccaagtgacattaggaacagatctaacaataagttaaaaaaaaatcaagctataatagtttatattcaatatgatttcaactgtgttaaatattctgtttgtttattttagagcagggttgtccaatattttggcttcccagccacattggaagaattgtcttgggccacacataaacatattaatgctgaggatagctaatgagcttaaaaacaacaacaacaaaaaaaactcataatattttaagaaagcttacaaatttatattaggccacactcaaagctgtcctggactgcatgcagcccacggccgaacaatcttgttttagagacagggtctccctggtctccttctgttgcccaggctggagtgcaataccacaatcatagcttccggtagcctcaaactcctgggctcaagtgatcctcccacttcagcctctcaagtaaccaggactacaggtgtgccacctacctggctaatttttaaatttttttgtagagacagtgtcttgccatattgcccaggctggtcttgaactcctggcctcaagcaatcctcctacccacctccccaaagtgctgggattacaggtgcgagtcatcgtgcctgcctatgttaaatattcttaataaatgattagacagaaggtaacatgacagtgacttaattgtggttgccctttagagatgagattatcagtggtattttgttttagcctgcttctgtttttctgtattttacaagatttctatcttgaacatgcattgctttttttttttttttttttcaatttgaaatacctttttttttttttttttttttttttaaactgatgggtaggctccatcttcagagattctgagccagtgggtctggagtagggcctggtacttgctcttttattttttaatttaatttttttacagagagtgtcttgttctgtcacttaggccagagtgcagtggcacaatcatagctcactccagcctcaaactcctaggctcaagtgatcctcctgccccagcctccccagtagctaggattacaggtgcgtgacactatgcccagctgactttaattttttttttttttttttgtagagacagggtctcgctaggtttcccagactgaccttgaactcctggcctcaagcagtcctcccacaatggcctcccaaatgccaggattacaggcatgagccaccatacctagcttctgttttgttttgttttgttttgttttctcacagtatgtgaatctcataagagttccatctccctgcctgcagctttttgactcaccaggataggaatatgcctctgagaactttttacgcacatgcctttacatgtctgcttcatttatgaactagtcagctctgtgtcaggccctgttgtaggtgtcgaggaaatatcactacaaaacagacaagaatccctccttcagagaccttacattccattgtggacacagacaataaacacggtaaaaaaataagatagatggcatgtaagatggtaaatacaagaataaaaaaaaaaagtaaggggatataaaatgtcagtagggtagaaattttacatggggtgacacagaaggccttcccagaaaggaacttttaatataaagacctgctggtcagtacagagctagccaggagactcttctttataactctgtctagatctgaaatttatcaggttatttgaccaatggcaaccccaaatcccaagattctgttctttactatcaccctgctcactgtcgtgtttatctgaatgttctgaactagagtcttatttgctatctctgttgttagttggtaggagacttgcagatctatactccttttaaaaacatctgaattgttttagatctcagggactcccaaaggatttcatcaggaggtgtccctaaagcttgaagcagcatttaattttcttctgcccacgttgacagactgactatagtattataagactttagttgacgtcctggcgatcctccatagttttcatttacacatgagtagagagcatttcacttgtctaaggtcctttcacaccattgctggaaactgcccatgacagccaacctgcagcccagagcaaaaggcataatgaatgtggaaggactctgcaggaccatacggagctatgtaaaagaaaggattattttgggggtgtaagagtcatttatatcaaatgcagccagacaaggagggattgcaaaatgttattctgtagaagtatgagcattagtggcgtaatacagcatcattacagtgatggtttcttcctgtatcccaaagtcccccagcctcctctcttcccctttctacctggaagtttacgaattctctctttgcccttgctgagacttagattctctggagtctgtcactcacctgcctctccatcagatattgtaatagtcatagttgtattctgcaaaatccgtgaaattcacatggctctagcctgaaatgtccagcctccactcctgctccctgacttctgctgtgccccctcctgctggtgtctgctccccttctctgcctgaggaatcctgctctcccatcagcaaccgccaacatcctggcacatgcagaggtcccggtttcccttgatcacaagggacctccttccttatgcctccctggtgcacaggaagtgtttgctggaaccgtttatgtggtaaagttgagtcggtgcctcagccatctgcatgaggaatgacatgggcctctggactctagatcaggctccagcctgatgtcccgagcagccatctatcatcctgcccgggagcacaaggcagccccagtggcagtataccaaatcattagaccaatatcatcattgtcccatgtgcggtatcttggttctttcttcaggcacggggtggaggattttagctgtaaaatatttacccacgcaccactgctaagctctgttctctgagtcaaaaaggggttgtgttcacacatggtttgggtgcatacacgagggaattacagagcacatagtccagttttctattgtttcattaccttagctgaggttttaagatgttaagtgtgtcactttggtcacacaaacttacttttacctctctttaattctggacatcggaaaagggagtccaggttagtggcgtggcttggagcctttccttcactatccacctgctgcatctgtggaggcttctccagcccctcacctgatgtggtagtgacagcagcaataatgttgcagctgtcgtttttacatgtttaccatgtgccaggtctagaataggcattttgcatatatcagctatatttcacgatcagctgagattcagagacctgaatgtgttcccggttacacagttgtcgaagtggagctgggatgcaggctcagagctaacgtccaccttcgaaactctaaagccgcgcttcctttccacctctttgtccattgtcttcaattcttttatttttatttatttatttattttttgagatggagttttgctctttgtggcccaggctggagtgcagtggtgcaatctcggctcactgcaactcctgcctcccgggttcaacggattctcctgtctcagcttcccaagtagctgggattacaggtgcctgccaccacacccggctaatttttgtatttttagtagagatgagttttaacaatgttggccagctggtctcgaactcctgacctcagttgatctgcccgccttggcctcccaaggtactgggattacaggcgtgagtcaccgtgcctgaccttgtcttcaattcttttttttttttttcttttttttgacagattttcgctctttcgcccatgctggaatgcagtggcgatctcggctaactgcagcctttgccttctggtttcaagcgattctcctgcctcagcctcccgagtagctgggattataggcgcctgccatcatgcctggctaatttttgtatttttagtagagacagagtttcaccatgttggccaggctggtctcaaactcctgacctagtgatcctcccgcctcagactcccaaagtgctgggattacaggcgtgagccactgtgcctggccgtgtcttcaattctttaaggtcttattctttcatcctgtctcctgctcatgcccaatgttcaagcatgttcccttaccctgtattcctttataatactcgctgcatagtgtcacagtatacttagcatctcaaaagcagtctttataggatgcaaccacactttaaaatagccctgaagaccccacatttacgttcttgaagtggcaactccgcctaccttgcaggtaacttctttatacttccaaccgtgctttggagaatggggctttttaacagtgtctcagaggactgtggtggtacagaaggtagacagagagtggactcatgcctaggagcttcatccttccccactgccactctggaggggttgcagagagggagcctcgaattagtcagaaagggctggggtgcttggttacagacggggccttttccaggaggcaaaagatctcagatgtctacgtgccctacaccgctgtctttcatgggacccgaggaaagctctcccaaggaacgggaggagtgggacttctgtccctcaggcttttatttttacttgtgatgtttttcttttcctggtttgctgccatcaatgccatttgcaaggccttttgtggggaggaggtataatctgcctgtttagttttggaagctgcttaaaggttttaggatttctgtcccactttcccacctagacgtgatgccaagggtaagaaggcatcggggaaactgggcaagtcgtaaagtaattattggaacagtcatacaattcaaattcctgccgttctgatatcgcttaattcttttgaagacctgaataaaatgtgttctttttctgagacatttagatacattgtttgaacaaaggaaacagggtgacttcaaaatgtccagtatgtggaaatcgatgccgttcagcctgtggtgtaattaatgaaaacattggcgacagtcggcctcattgtttgtcattgtgcaacaggaggtggtacactaataaggagccggggaaggtttacgtaattcagaaggaagcagacgtgtgcagttttgactgatgcccttctcactgcagatccaggctcaccgagcaggttcctattcctgatggacgtggagatgtctgattggattttgtcatttgatttttgacactgattaatgatagatttttatttcccttatggtcagaaataattgtcttgaaaagcttcactttagatcatagttttcacacacagttataattcattgggtaaagcatagtagaacaaactatggaaaaggaaatgtcattggtagactttggtcgcttaggacaggtgtggtggcccttggaatcaggagatctggagttctgtcctggccccatcagtcccagctgtgtgagcttagggatagtgcttgcccactctgggagcagccttcatctgtaaaaggagggggttgctcaggacccttgcacctccttccttttacagatgaagattgctttgtctaagcccccttggtgaggtcaagaattgtgaaatgtttgtacaagtgagatgtcaagagtacaaaatgtacagacgaactgccagtgaaaatgtcatttaagtttatctgctaacagtttattccctttggtctcctctcagtttttgttttgtaattgtccatgttttgtctggtaatttattattttttttattagaaaagtaaacaccaaagtgtttttccattccgcttgacagcataacaaattgccatttaaattcatctcttaaggatttcaaaaaggcattaaacacactgctcaacatggtatgtatttaattgaaatgagctgacttttgaattaattagctctttagaaaaaataggcaaaaatggagccgaaaagcatgggtttgaattctggcttcactgctagtacgagctgtgtgaccctgggcaccttttctcatctctgaatctctaatttctcatctctaataggagagggacactttccctatgagagtgtggtgaggtataaagataatgtatgtaaactgcacagtacagtatctgacagttagtagatacttaatggatagcagctgtaactgttatacattattttattacaataattaaaataactagagaatttgtgtatattatatactgggttctatctaccaaatcattctaatatgatgtgcattgattaccaaaagaaatagtcctccagtatggatgccagttttgtttctgttagagtgtgtggagtgagatttaccagagagggatttctcttttctggttgacagatcaaaggtacgcctatgagaatacatggcaagaatttattcttttttttttttttaacagtgataaaatatactttactttgttgagtcagagggttgtaaaaaaaattattgctaaagtaggtatcaggcaaacagaaaggtgctttagaagtccagttaccttggagtttatttaaactaagagaaaaacgtcataatgttttcatgcgatacatatctggttctttaacaattgtgtgacaaacagcagaaggaattaaggaatgccgcacttgtgatccatacaaaacaccaacactttaggttgtacataattaaagaaatatctcaaacactttttaaaacactgtagtagccaatacatagaggcatgccgtaggtaggcacaggaatgcagtttagaaaaataaataaatcacataggaactactcaatttccttaaaatcactgagcaagaaaagcaacattgaactggctgggcgcagtggctcacgcctctaatcccagcactttgggaggccgaggcgggcggatcacgaggtcaagagatcaagaccattctggccaacatggtgaaaccccgtctaatttttgtactaaaaatactaaaagtactttttttgtactaaaagtacaaaaattagctgggcgtggtggcgctcgcctgtagtcccagctactcaggaggctgaggcaggagaatggcgtgaacccaggaggcggagcttgcagtgagccgagatcgcaccactgcactccagcctggcgacagagcgagactctttctcaaaaaaaaaaattaaaaaaaaaaaaaaaaggaaagcagcattgaactttcatattgattttacacagcttttatacagtaccttgacttaaatccaagagcaaaacttgactgtcctcctctatttttggtaaacttacgtgactttcccccctggattttacctgggagtagcctttttaaatttttatttaaaagagggcaggtttggcactttatagtaatgtcaccaatgttaatatttcttgggatctcaggaagattcacattttttacagctgatacaggttcagcacaggctgaagctccccctcagccagcctcagatttttccagcttattttgtgcaccaatttgtgtaacaatcccattcatgtttgtctccaataccattcccccatcatcatttctgcaagaatattgtgaaccgtgtctacatggaaaatcaaatccagttcacaaacattttcaaaacatttgtctaatgtttccacaaatccatagggctggtagaacttggagagccgcggtttcccatgattgttaagattaggatcgccttgatcgtggctgggtcgggcccaccgggtaggcactgggggccagggtgcgggccggcgcgcaagcctcgcctcgtgatcttgccggcgatccttccccacccactccctcccgcacgccggcaagagtttattcttacaggctgccattgcaaactactgtcttcagaaacaaggtcacttcaaagtgtccagaatgtggtaattggtgccattcagcctgtggcgtaattaaggaaaacatttgcccattgttgtccattgtgctagagagaggcgtccaggaaagattcatactcccaaaccctccatgggagtggtgatctggagagggtcggacagccagaaagcacatagttgaccctgaaaggttttgttgcagcctgtcataccctaacctttataatctgtctgaatctctactgcaggtcaagtagccatggtctggtggggatagaggtggcaggtgggctagaacgtgccatatcttgatttgtggcaatgggcctcctactcttcggagtggagacagctaataccatgagtcaaagaccaaatcgggatagccgatgtataaaaacacaagcaccgggtttgcaaactggaagaaaggtcttgaagaaggtgtcagaagcaaaaaatggtaagtatgtgaggaggtggatattttaattagcatgactatagaaatcatttcactatgtatatgtatgtcaaaacatgtgtgctgtaaatatatagtttttattttttaaaaaatgaatgctgtcagtatgagtccatttaaaaataagcaggcttaaaggttcaaggaaattgctgagaactggcatctcacgcttccttttggggttagtcgatgcatggtatggctaatgtaaagatccaggatcttatgaacacagctttttaccttggactgttcctcttgcagactcagctaccaccttcctttaggattaaaaatgttttacttagcctcaacaatttgttttagagccactttcatagtgcctagtcctggattcccaaataggtttcttcatcttcgtaaactcgaaagtggccatctggggttcagtgtcaggaagggttctgagtccaagtcagatttaaagaataaccatgatgcattactggtatctgtcgggggtctgggagaaggaattgaatgtatttgaatacacttattttattattttttaaaactgagttatcattcacgtagttcacccttttacagtgtgcatttcagtggttttagtattcttgcaagattgtgcagctacaccactatgtaattccagaacattttcatctgcctagaatgaaactctatgtacatcagcagtcactccccatacctctattcccctatcccctggcaactaccagtctcctttctgtctctctggacttgcctgttgggggtatttcatataaagggaatcatgtgatatgtggcccttgtgtctggtttcttttacttagcataatgttttcaaggtttatccatgttgtagcttatatcagtatctcatatctttttatggatgaacaatattttattctatgaatagaccacattttgtttatccatttttcagtggatggatatttgggttgtgtctactttttgcctattatgaataatgctgctataaacatttgtgtacaaggttttgggtgaacatataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatgaatattagccattattatccccacttttaaaaagtagaagctgagagtcagcttgtgatttgcccaagttcaccaactagtagaatttaaattcaggccttctgacttactttgttaatggtaatgaattattagtgatgtcagggatttgaagggtgagcttacattgctaaaaatcagcaatatgcccatcttcaaataacagattgttactgacttcagaatgtattatttgaatagctgtaaaacaggatgaattgttacttttccatttagcctctttagctacaaagtacttacaataaaagagcagaattacatatcactgcctgctcattacattttgaacccagaaggaaatccacccaaagaaagaacaaagctgggaatggatttagaaccctaaaaagaggcagcctttggttagctgaccttgaaccatccatcatgcctcctcctcccagcctccatattcctaaactgacatccttggggaacaggaatttaaatgtagaacgagtgcagagaaagtgagatatctattgagatcaaataaaaattgaccttgagactaacattaactgacagacaccacattaaaagctaaacattacctttaaagggtgggaaagatgagtgactttttaaatgccgtcttgagctgggcacagtggcttacgtctgtaatcccagtactttggaaggacgaggagggcagatcacctgaggttaggagttcgagaccacctggcctacatggtgaaacgctgtctctactaaaaatataaaaattagccaggcgtggtggcacacacctgtaatcccagctacttgggaggctgaggcaggagaattgcttcaacccaggaggtggaggttgcaatgagctgagattgtggcactgcactgcagcatgggcaacagagtgagactcggtcttaaaaaaaaaaaaaaaagcagtcttgattaagtccatatgcagtcttttttgtttttaacatttcttttaaacttaagtattttggggatagaaaaataagtctattgatcatatggatgtgaattttgttaactgtgaaacacagcttacctactcatttttcttttgaccatgagggttattaaatttgcttttgatcatttcatgcatatctacatcttaagtttttagaatttaaaagttgtacactatctttatgaagttcttactgttatgttgcacatcttttctaacttaaaataagcccttgtagtatgtcactaatttggaaaatttacctttactttgaaaagaactacatcaagcatagtgaggccaggtgtggtagatcatgcctgtaatcccaacactttgggaggctgagcgggtggatggcttgggccaggagtttggagatcagccagggcatcatcttgagaccccatctccacaaaaaataaaaattagccaggcatggtggcatgtgcctgtagtctcagctactcaggaagctgagatgggaggattgctcggacccaggagttcaaggctcccgtgagctatgatcaggccactgtactccagcctgggcaacagagcgagaccctgtctccaaataacaaaccacagtgacatctttcataggatgacccatctgcctcaaaccagcatcaaagcttattttatgaggaaaatttatataacaaaagtttttgaagcaccgtactctcttgttggagaggatatcatttattaaagcttttggttttgctttcaaaatattttttgaaaaatatacatgtacgcatgtacgcctatgtatttttatttttaccatattggatagcatcaaacagtggtaatagttattctcatggctaaacatatagattaaaaacacatggaaggacttgtaggtaaataatgatttcagttattacgtagtgcgaaatgattctatcaggaaactgtgggatgagtaatgtgactctgctgtaagattttcagtagcagaagtacagaacaaaaataaaacatgtcagcaaaaaacacaatggtaagttgtcatctgagtgattgtgtaagccttgaagatagttaatgtaaccgagatgaggcgtccacataagctcctgccttcacaatagatatgttgtgtctatttggatatcacaaaatgtcattcggttttttattctgctttcatgtactacatttcttatcttgctttttcattcttcatgtaaaagaggtttctagacagagtttctgtttcagttcacatatattttatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggtcatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaacacggtgaaaccccatctctactaaaaatacaaaaaattagctgggcgaggtggtgggcgcctgtagtcccagctacgcgggaggctgaggcaggagaatggcgtgaaccccggggggcagagcctgcagtgagccgagatcgcgccactgcactccatagaagctctctcccctccccacaaactctgagtcactcagcttgagctcaggaatgatttcagatgtctaaacaggtcatttgcagggtctgggtagtctgcccacagaggaggtaaaagctctggctcaatcttgaaccattgcaaatttaagccagtggatctgaaggcaattgagttctgttctgccactccagctcaggcaggacagctgcttccctgaaacagggccctctgaggttagatgtacagcctcagtgggcatcagtgtcatgaatagccgctcctcatttggcagcagtaactatccagagacaaaggataggattcgggataaccgtggtcataagctagaagtctccagagtccttagaggaatttgaaaactgaacagaatttttttctttccacactgtgtcagggctttagcaaaggagttctgttgtgacaattgtctgggtaacatctgcctactgttttttgttttgttttgttttgttttgttttcctgatctgtagtccatcttgcttaacagtgcccaagggcacaagcttcacactgttaatagttttactcttaacacctccttggctcctttgtcccaagaaggtgagatcccacttccaggtgatctcctgcaggacttttccctgagcctctaacccatttctagcccatatttccccctcaagaacaataattcagtaatgttttcagttctcctgaaacaatcccaaattttggattttttcttaatgttgaattataagagttattgatatattcattctggatgtaagactgtcatttgatatatagtgaaattttttctttctttgtttatttttgcccattattttcatagggaataaaatattatgaaatgttctcagtctgctgcttgccttttcattttatttcttttcttttctttcctttttttttttttcttttttgagacagtctcgctccgtcacccaggctggagggcagtggtgcgatcttgactcactgcaacttctgccttttgggttcaagagattctcctggctggccacggtggctcacgcttgtaatcccagcactttgggaggccgaggcaggtggatcatgtggtcaggagcttgagactatcctggctaacacggtgaaaccccatctctactaaaagtacaaaaaattagctgggcatggtagcacacgcctgtaatcccagctactcgggaggctgaggcaggagaattgcttgaacctgggaggtggaggttgcagtgagtcaagatcgcgccactgcactctagcctgggtgacaaagccagactccgtctcaaaaaagaattaaaaaaaagagagagatagtctcctgccttagcctcccaagtagctgggattagcaggcatgtgccaccaggcccgactaattttgtatttttagtagagacagggtttctccatgttggtcaggctggtctcgagctcctgacctcaggtgatccacctgccttggcctcccaaacttctgggattacaggcatgagccaccgcacccggccttaatggtatctttttaagagaagtttttagttttgatgaaaatcaatttaaccatttttattttatggttaacactttttgaaacttagaaatctttgcataccccaaggtagcaattttttttttttttaaagacagggttttgctcttgttgcccaggctggagtgcaatggcataatctcggctcactgcaacctctaccttccaggttcaagtgattctcctgcctcagcctcccaagtagctgggactataggcatgcaccaccacctccagctaatgttttgtatttagtagagacgggatttcaccatgttggtcaggctcgtctcgaactgctgacctcagatgatccacccgtctcagcctcccaaagctctgggattacaggcgtgagccactgagtccagccaaggtagcaaagatttttctcctatattttcttctagaagttttatagttttagcttccatatttaggtctgtgatccattccatattaatttcttgtgtatgcactgtgagatgtaaggctccaggttcattctttctctttgtggatatctagatattctagcacaaattgttgaaaaacttttttcccccattaaattgccttgagatctttgtaacaacaataaaaaaatcaattaacaatatatttttagatcatttttacactgtcttttgttttatggatctgtgtgtctctatgccagcaccacactatcctgattactgtagttttatagtaagtcctgaaatcaagtactgtaagtcttcaaactttgttctttcaattattttggccattctgtgtactaagaatcagcttaccaattcctgtaaaacaatgccttctagactttttacttggattgcaaatgaacctcttaatcaatttggcaagcatcagcaccttgaccgtgttgaatctgacaatccatgaacatgatatacttcatttcttgagatcccttttagtttttcagagcgatgttttgtaatatcagtgtacagatcttatacatattttgctgaatttttccctaagtatttcatgttgccgacgcagttgtaaatagtattcttttattccactgtcctgtcattcattgttatgtagaaatacaattgatttctgtatgctgaccatgtatcttgcagccttgctaacttcactttagtagtttttagtagatttttaaagattttctaagtgtattatcatgtcatctgcagataaagacccttttgcttattcctttctaatttctttgccttttacttaatttattgcattggctactgcatatagtacaatgttgaatagaggtggtaagagtgtagacatgcttgccttgttcctaatcttagggagaaaagtgtctttcaccaataactgtattgtcagctggaagtttttcatagatgcactttatcaggttgaggaagtttccttctgttcctactttgctgaaaatttccataataaatgcatgttcagttttttgagtgctttttcttatatccattgagacaatcatagatttctaacctctattctgttgaaatggcaagttactttgattgatttttcagatgtcgaaaaagtgtgtctccttgacataagcattgcttggtcataatgtattatcctttttgtatatttctggattttatttgttaatattttgagttcatgtactgagtggaccagccaagtaggcagatgggcccgcaccatccatataaggtatttggaacaactttgagcacattctacagatgcctaataaccttagtgaggcctgcagttctatgctcaaataacctccccttctttttcacttgtcctttgaaatggactgccccagagatggtatatgaatctgtagggcaaagtttgaagtatgagcttgagtaaatgatgagttccttgaagacaaaggctttattgcattcttttttttttttttttttccccctgggatagggccttgctctttttttccaggctggagtgtagcggtgtgatcacagctcactgcagcctggacctcctgagagcaagcaattttctcacctcagcctctggagcaggtgggactacaggtgtgttccatcacacctggctaatttttattttattttttgtagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttgaaaatcagctagtttattcatttaatttttcttaagttcctgaaacaaagttatttgcaatttatatgtttctgggcctgagtttcctggaatagtaaagtcatgttaacagaaacagtggaaaagaaaattcatgttaatgtacacggtaagctgtgtgggtgtaagtagttttggttctcaatatctatcctaggacctcgcatagtgcatggcacatggcacgtgatgctactcaataactgtctgttgcctgtgtggtaatagctcacacttacccagtgctcactgtgtgctgggcaggatgataatgttctccttgcagaatctcatttaatcctcaggacagtcttttaagtggccactcttgttatccccactaccttgcagatgaggaaaccgaggcttacgtatattttcattcatttattcaacaaatatttattcaggacctgctatgtgctgggtactggagatatagcagggtttaaagcacaccaaatccttgctctcatggaatcagccttctgggtaattttctaaaatcacatagatactgggtcgagggtagcccttaaacctaggtggtctgactcctgaacttgcaatcttaaccgttgttttattggtagatgaatggattgatgagtgtggtgaacaaaaattgtgactatccatttcacaaacagcttcgtggttgccctttagctccagcttggatggttagattgccctgtctgaagctggatttattttattttatttatttttggagatggagtctcgctctgtcacccaggctggagtgcagtggtgcgatcttggctcactgcaacctctgcctcctgggttcaaacgattctcctgcctcagcctcccaagtagttgggactataggcgcacactgccacgcccggctaattttttgtattttaatagagacggagtttcgccgtgttgcccaggctggtctcgaactcctgagctcaggcaatccgccctcctcagcctcccaaagttctggtatgagccaccacgcctggccaagctgggtcttttgaatggctatgggtgctcagtgaggcaaccctaggtgatatcataacacctctgcttatccagaagacaattagtatatatgttatcttgttagaatccatgtgccaaaaatagaaataggaaaggcaaataaggatatatccctagattgtcaaaatggtgattcagaattgtgtgagatactggtttactgcctacagtcacatcaaatgtgttacaatgagcatgtgtctgggggttcgtggagtaaaggtagggattatggatcaaggacaatgttacctcaagagcaaaggtcagagacatcaaaaataggcatcaacagttttaccatccttttccagatagtccattgttgcttgcaccaagttgagactttctttgcaacaaagaatgggggaaacatttaaaaggtaataactttccctacatgtgatctagtcttctttaatgcagtgccacgtgccaacaaaagtctcataaagcaccagtgatacagggtcttgctcaggaaatatgtgtaaaagaggggagctgctggacttcggagagctggggtccagtgtaggttctgtcactgtgagatcttcaaagtcacgcaaactcaagtttcctcttgcggtttttttcttccatggagcataatggaagtaagacatgatgtcagcacgcatgaacaacctgtttgaactcagtgtgctcatctcagcattaacagaaagtgcctttacaaaagctttggagacattaaacacgggccccagctggatgtggaaacatgtagggaagtacatgccatttgacaagtacctgtgaagatggctgtgaacagtcttcatcaggtgtgaatcggggatggattgactgccaaggactttagacttgataagttagagccttggaggccatttcagatagaaactcttcaagcatctatctagtctggtagggttgcggggtggagggccaggaatgccctgccaagtaaaatgtgatgcccgagaaggttcccaattcaggattccacctggctcccacgagccccgctgtctctcaggtgtgtggagtgtttctcagtgctcattgcaaggccaccctgaaaaggcccagcgggtgactgtcaggaccacaggactctcctggctcactacttccaaagtgctgagcgccagacagggctgcagagaaccccggaaagtgtgcattgtttccacattatttggagtttctcactcccatgttttttttttttttctcttctccttctccccgtgcccaactagctgctcctcctgccctgcaggcactcaagcaagaggcccgccagaggacagcaacactgatgtgcttcggtcgcctcccgcccctcctgccctccccacagatgatagcaaaagggaaattattttttcttggggctggctttggtcccccgtgttttcatgagtttgtttttgtgtctctcgaagccattttcagaggctctctggtaccgggtgttgagcccttgtcctgatgcaaggtcgggaaggggcgtgctccaggaataaaccagaaggaagggctggaggagcctgggaaccttgggataggagtgtgggcctcagtagttgagctgttttctcctggcctgggaaagaaacaaggggtgagggggtggaagtggggtccatgctgaggaaggggtgcaagtgcccaacacgatggcggtctctctctctatttttatctgggtgatgggtactaaagagcctctgtaaggggaagagaagaagtcacgcaagggcagcccagagcccgcagtttctttaatgggggagaagggcacatgagatagtcctcacagtttgacaaatgtggtgtgttgtaaggacgggagccttggttgcatttttggccctggcagggagagcctcccttccattgcagtgttccccgagtgtccgccaaactgcagccgtccagggaagagaaggattgagtgaagaacatgcattttggggtttgggatttttgttattgttgttagaaacagggtctcactgtgtcgcccaggctggagtgcagtggcatgatcatggctcactgcagcttcgaccttctggactcaagccatcctcccacctcagcctcccaagtagctgggattacacgcacacaccaccacgcccatctgctcctagtttttttctagataagcaacctgagacacaaaggataagcattagcagctcatacacgtgacagagccagattcagccttggcctgactgatttccacatccagaattcccctcatatagggagatagaaatctcaggatctcaacaaggtacaaataacgcacattcccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaattt
